US008192927B2

(12) United States Patent
Van Den Brink et al.

(10) Patent No.: US 8,192,927 B2
(45) Date of Patent: Jun. 5, 2012

(54) HUMAN BIND MOLECULES CAPABLE OF NEUTRALIZING INFLUENZA VIRUS H5N1 AND USES THEREOF

(75) Inventors: Edward Norbert Van Den Brink, Halfweg (NL); Cornelis Adriaan De Kruif, De Bilt (NL); Mark Throsby, Utrecht (NL)

(73) Assignee: Crucell Holland B.V., Leiden (NL)

( * ) Notice: Subject to any disclaimer, the term of this patent is extended or adjusted under 35 U.S.C. 154(b) by 522 days.

(21) Appl. No.: 12/310,812

(22) PCT Filed: Sep. 6, 2007

(86) PCT No.: PCT/EP2007/059356
§ 371 (c)(1),
(2), (4) Date: Mar. 6, 2009

(87) PCT Pub. No.: WO2008/028946
PCT Pub. Date: Mar. 13, 2008

(65) Prior Publication Data
US 2009/0311265 A1    Dec. 17, 2009

Related U.S. Application Data

(60) Provisional application No. 60/842,930, filed on Sep. 7, 2006.

(30) Foreign Application Priority Data

| Sep. 7, 2006 | (EP) | 06120316 |
| Sep. 14, 2006 | (EP) | 06120644 |
| Nov. 30, 2006 | (EP) | 06125107 |
| Jun. 28, 2007 | (EP) | 07111235 |

(51) Int. Cl.
*C07K 16/08* (2006.01)
*C07K 16/00* (2006.01)
*C12Q 1/70* (2006.01)
*A61K 39/395* (2006.01)
*C12K 16/00* (2006.01)

(52) U.S. Cl. ........ 435/5; 435/7.1; 424/130.1; 530/388.1
(58) Field of Classification Search ................. None
See application file for complete search history.

(56) References Cited

U.S. PATENT DOCUMENTS

| 4,625,015 A | 11/1986 | Green et al. |
| 5,631,350 A | 5/1997 | Okuno et al. |
| 6,265,150 B1 | 7/2001 | Terstappen et al. |
| 7,091,324 B2* | 8/2006 | Foung et al. .............. 530/388.3 |
| 7,371,383 B2* | 5/2008 | Reed et al. ............... 424/145.1 |
| 7,579,446 B2 | 8/2009 | Bakker et al. |
| 7,696,330 B2 | 4/2010 | ter Meulen et al. |
| 7,740,852 B2 | 6/2010 | Bakker et al. |
| 7,858,086 B2 | 12/2010 | Geuijen et al. |
| 7,960,518 B2 | 6/2011 | Throsby et al. |
| 2008/0014204 A1 | 1/2008 | ter Meulen et al. |
| 2008/0070799 A1 | 3/2008 | Bakker et al. |
| 2009/0054254 A1 | 2/2009 | Throsby et al. |
| 2009/0104204 A1 | 4/2009 | Throsby et al. |
| 2009/0130652 A1 | 5/2009 | Throsby et al. |
| 2010/0069614 A1 | 3/2010 | Houtzager et al. |
| 2010/0146647 A1 | 6/2010 | Logtenberg et al. |
| 2010/0172917 A1 | 7/2010 | ter Meulen et al. |
| 2010/0272724 A1 | 10/2010 | Bakker et al. |
| 2010/0297153 A1 | 11/2010 | Geuijen et al. |
| 2010/0303801 A1 | 12/2010 | Throsby et al. |
| 2010/0310572 A1 | 12/2010 | Bakker et al. |

FOREIGN PATENT DOCUMENTS

| WO | WO 98/15833 | 4/1998 |
| WO | WO 02/103012 | 12/2002 |
| WO | WO 2008/028946 A2 | 3/2008 |

OTHER PUBLICATIONS

Okuno, et al. "A Common Neutralizing Epitope Conserved between the Hemagglutinins of Influenza A Virus Hi and H2 Strains" J Virology, 67(5):2552-2558, 1993.*
Kunert R. et al. Characterization of Molecular Features, Antigen-Binding, and in Vitro Properties of IgG and IgM Variants of 4E10, an Anti-HIV Type 1 Neutralizing Monoclonal Antibody AIDS Res. and Hum, Retroviruses, 20(7):755-762, 2004.*
Tamura M. et al "Structural correlates of an anticarcinoma antibody: identification of specificity-determining residues (SDRs) and development of a minimally immunogenic antibody variant by retention of SDRs only". J Immunol. Feb. 1, 2000;164(3):1432-41.*
Kashmiri S. et al. "SDR grafting—a new approach to antibody humanization". Methods. May 2005;36(1):25-34.*
Huang; "Structural basis of tyrosine sulfation and VH-gene usage in antibodies that recognize the HIV type 1 coreceptor-binding site on gp120" PANS, 10(9):2706-2711, 2004.*
Smirnov YA et al. "Prevention and treatment of bronchopneumonia in mice caused by mouse-adapted variant of avian H5N2 influenza A virus using monoclonal antibody against conserved epitope in the HA stem region" Arch Virol (2000) 145: 1733-1741.*
Vareckova "HA2-specific monoclonal antibodies as tools for differential recognition of influenza A virus antigenic subtypes" (Virus Research 132:181-186; 2008).*
Okuno et al., A Common Neutralizing Epitope Conserved Between the Hemagglutinins of Influenza A Virus H1 and H2 Strains, Journal of Virology, May 1993, pp. 2552-2558, vol. 67, No. 5, New York, US.
Smirnov et al., An epitope shared by the hemagglutinis of H1, H2, H5 and H6 subtypes of influenza A virus, Acta Virologica, pp. 237-244, Aug. 1999, vol. 43, No. 4.

(Continued)

Primary Examiner — Bo Peng
(74) Attorney, Agent, or Firm — TraskBritt

(57) ABSTRACT

The present invention relates to binding molecules such as human monoclonal antibodies that bind to influenza virus H5N1 and have neutralizing activity against influenza virus H5N1. The disclosure provides nucleic acid molecules encoding the antibodies, their sequences and compositions comprising the antibodies and methods of identifying or producing the antibodies. The antibodies can be used in the diagnosis, prophylaxis and/or treatment of an influenza virus H5N1 infection. In a preferred embodiment, the antibodies provide cross-subtype protection in vivo, such that infections with H5, H2, H6, H9 and H1-based influenza subtypes can be prevented and/or treated.

11 Claims, 7 Drawing Sheets

OTHER PUBLICATIONS

Horimoto et al., Antigenic differences between H5N1 human influenza viruses isolated in 1997 and 2003, Journal of Veterinary Medical Science, Mar. 2004, pp. 303-305, vol. 66, No. 3.

PCT International Search Report, PCT/EP2007/059356, dated Aug. 21, 2008.

Ekiert et al., Antibody Recognition of a Highly Conserved influenza Virus Epitope, Science, Apr. 10, 2009, pp. 246-251, vol. 324.

U.S. Appl. No. 13/315,475, filed Dec. 9, 2011, van den Brink et al., Human Binding Molecules Capable of Neutralizing Influenza Virus H5N1 and Uses Thereof.

Lerner, Richard A., Rare antibodies from combinatorial libraries suggests an S.O.S. component of the human immunological repertoire, Mol. BioSyst., pp. 1004-1012, vol. 7, 2011.

U.S. Appl. No. 12/589,181, filed Oct. 19, 2009, Logtenberg et al., Antibody Producing Non-Human Mammals.

U.S. Appl. No. 11/990,974, filed Feb. 21, 2008, Throsby et al., Method for Preparing Immunoglobulin Libraries.

U.S. Appl. No. 12/590,973, filed Nov. 16, 2009, ter Meulen et al., Binding Molecules Against SARS-Coronavirus and Uses Thereof.

U.S. Appl. No. 13/068,784, filed May 19, 2011, Throsby et al., Human Binding Molecules Having Killing Activity Against Enterococci and Uses Thereof.

U.S. Appl. No. 12/227,029, filed Nov. 5, 2008, Throsby et al., Human Binding Molecules Having Killing Activity Against Staphylococci and Uses Thereof.

U.S. Appl. No. 11/980,237, filed Oct. 29, 2007, Bakker et al., Binding Molecules Capable of Neutralizing Rabies Virus and Uses Thereof.

U.S. Appl. No. 12/459,661, filed Jul. 6, 2009, Bakker et al., Binding Molecules Capable of Neutralizing Rabies Virus and Uses Thereof.

U.S. Appl. No. 12/798,748, filed Apr. 8, 2010, Binding Molecules Capable of Neutralizing Rabies Virus and Uses Thereof.

U.S. Appl. No. 12/803,125, filed Jun. 18, 2010, Geuijen et al., Binding Molecules for Treatment and Detection of Cancer.

U.S. Appl. No. 11/667,640, filed May 11, 2007, ter Meulen et al., Compositions Against SARS-Coronavirus and Uses Thereof.

U.S. Appl. No. 11/919,265, filed Oct. 24, 2007, Throsby et al., Host Cell Specific Binding Molecules Capable of Neutralizing Viruses and Uses Thereof.

U.S. Appl. No. 11/922,405, filed Dec. 13, 2007, Throsby et al., Optimization of West Nile Virus Antibodies.

* cited by examiner

HUMAN BIND MOLECULES CAPABLE OF NEUTRALIZING INFLUENZA VIRUS H5N1 AND USES THEREOF

CROSS-REFERENCE TO RELATED APPLICATION(S)

This application is a national entry under 35 U.S.C. §371 of PCT International Patent Application PCT/EP2007/059356, filed on Sep. 6, 2007, designating the United States of America, and published in English on Mar. 13, 2008 as WO/2008/028946, and claiming priority to U.S. Provisional Patent Application 60/842,930, filed Sep. 7, 2006, EP 06120316.2 filed Sep. 7, 2006, EP 06120644.7, filed Sep. 14, 2006, EP 6125107.0 filed on Nov. 30, 2006, and EP 07111235.3 filed on Jun. 28, 2007.

STATEMENT ACCORDING TO 37 C.F.R. §1.52(e)(5)—SEQUENCE LISTING SUBMITTED ON COMPACT DISC

Pursuant to 37 C.F.R. §1.52(e)(1)(ii), a compact disc containing an electronic version of the Sequence Listing has been submitted concomitant with this application, the contents of which are hereby incorporated by reference. A second compact disc is submitted and is an identical copy of the first compact disc. The discs are labeled "copy 1" and "copy 2," respectively, and each disc contains one file entitled "seqlisting.txt" which is 647 KB and created on Mar. 2, 2009.

FIELD OF THE INVENTION

The invention relates to medicine. In particular, the invention relates to the diagnosis, prophylaxis and/or treatment of an infection by influenza virus H5N1.

BACKGROUND OF THE INVENTION

Influenza viruses consist of three types, A, B and C. Influenza A viruses infect a wide variety of birds and mammals, including humans, horses, marine mammals, pigs, ferrets, and chickens. In animals most influenza A viruses cause mild localized infections of the respiratory and intestinal tract. However, highly pathogenic influenza A strains such as H5N1 exist that cause systemic infections in poultry in which mortality may reach 100%. Animals infected with influenza A often act as a reservoir for the influenza viruses and certain subtypes have been shown to cross the species barrier to humans.

Influenza A viruses can be classified into subtypes based on allelic variations in antigenic regions of two genes that encode surface glycoproteins, namely, hemagglutinin (HA) and neuraminidase (NA) which are required for viral attachment and cellular release. Other major viral proteins include the nucleoprotein, the nucleocapsid structural protein, membrane proteins (M1 and M2), polymerases (PA, PB and PB2) and non-structural proteins (NS1 and NS2).

Currently, sixteen subtypes of HA (H1-H16) and nine NA (N1-N9) antigenic variants are known in influenza A virus. Previously, only three subtypes have been known to circulate in humans (H1N1, H1N2, and H3N2). However, in recent years, the pathogenic H5N1 subtype of avian influenza A has been reported to cross the species barrier and infect humans as documented in Hong Kong in 1997 and 2003, leading to the death of several patients.

In humans, the avian influenza virus infects cells of the respiratory tract as well as the intestinal tract, liver, spleen, kidneys and other organs. Symptoms of avian influenza infection include fever, respiratory difficulties including shortness of breath and cough, lymphopenia, diarrhea and difficulties regulating blood sugar levels. In contrast to seasonal influenza the group most at risk are healthy adults which make up the bulk of the population. Due to the high pathogenicity of certain avian influenza A subtypes, particularly H5N1, and their demonstrated ability to cross over to infect humans, there is a significant economic and public health risk associated with these viral strains, including a real epidemic and pandemic threat. The scale of the threat is illustrated by the 1918 influenza pandemic which killed over 50 million people.

Currently, no effective vaccines for H5N1 infection are available, so passive immunotherapy with immunoglobulins may be an alternative strategy. Use of passive immunization during the 1918 pandemic reportedly halved the death rate. In view of their therapeutic benefit in humans, there is thus a need for binding molecules, preferably human binding molecules, capable of neutralizing H5N1. The present invention provides these binding molecules and shows that they can be used in medicine, in particular for diagnosis, prevention and/or treatment of H5N1 infections.

Figure 9:
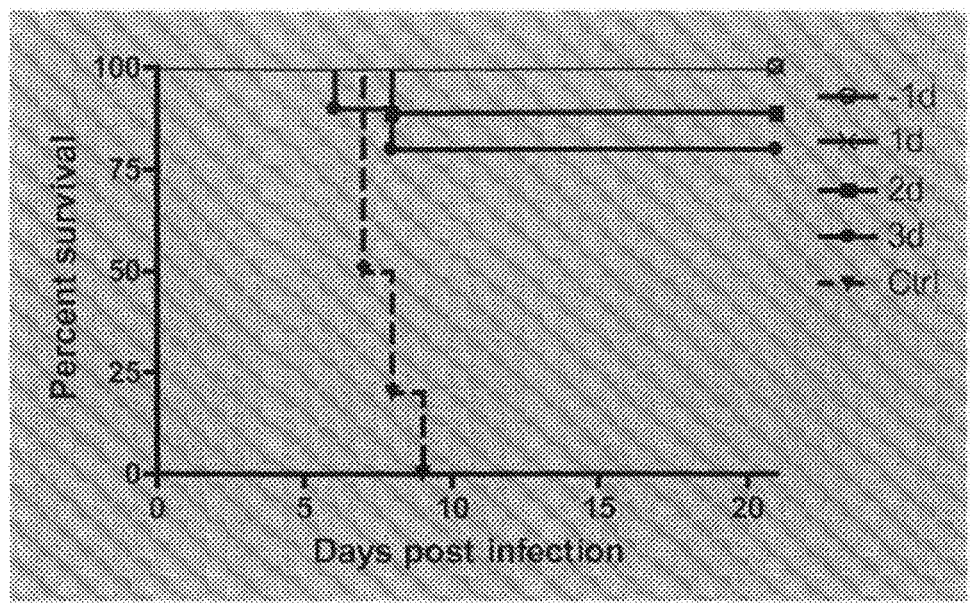

FIG. 9 shows the percentage of surviving animals in each group of a study wherein mice were infected with a lethal dose of H1N1 influenza virus and treated at different time points (1 day prior-, 1, 2 and 3 days post-infection) with CR6261 anti-H5N1 monoclonal antibody, or a non-related antibody CR57 (administered at day 1 post-infection).

Figure 10:
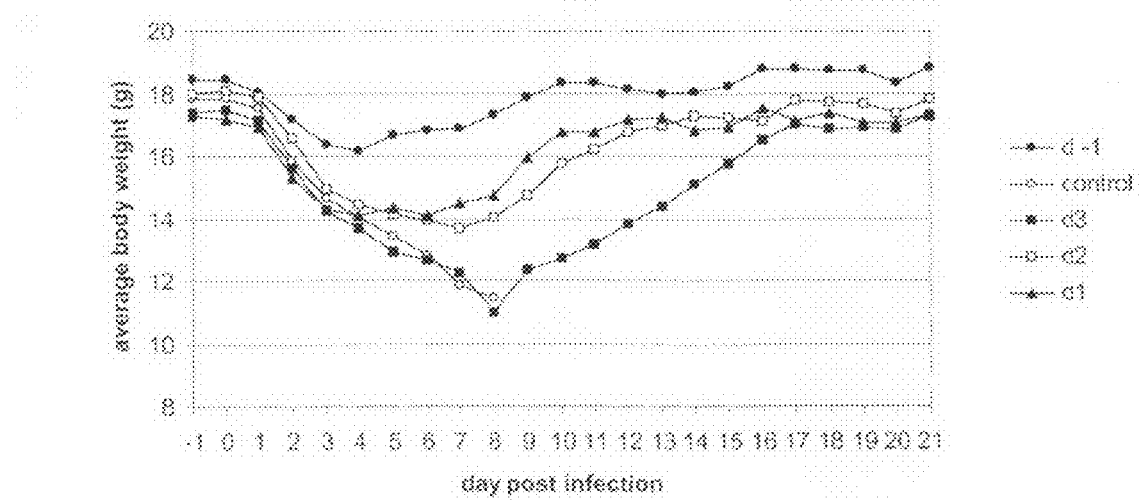

FIG. 10 shows the average body weight of the mice in each group during the study as described for FIG. 9. Measuring the body weight of the mice in group 5 stopped at day 9 as all mice in that group had died by that time. All remaining mice in groups 1-4 reached normal levels of body weight at day 21 post-infection, although it depended on the time of treatment how fast each group recovered.

DESCRIPTION OF THE INVENTION

Here below follow definitions of terms as used in the invention.

As used herein the term "binding molecule" refers to an intact immunoglobulin including monoclonal antibodies, such as chimeric, humanized or human monoclonal antibodies, or to an antigen-binding and/or variable domain comprising fragment of an immunoglobulin that competes with the intact immunoglobulin for specific binding to the binding partner of the immunoglobulin, e.g. H5N1. Regardless of structure, the antigen-binding fragment binds with the same antigen that is recognized by the intact immunoglobulin. An antigen-binding fragment can comprise a peptide or polypeptide comprising an amino acid sequence of at least 2, 5, 10, 15, 20, 25, 30, 35, 40, 50, 60, 70, 80, 90, 100, 125, 150, 175, 200, or 250 contiguous amino acid residues of the amino acid sequence of the binding molecule.

The term "binding molecule", as used herein includes all immunoglobulin classes and subclasses known in the art. Depending on the amino acid sequence of the constant domain of their heavy chains, binding molecules can be divided into the five major classes of intact antibodies IgA, IgD, IgE, IgG, and IgM, and several of these may be further divided into subclasses (isotypes), e.g., IgA1, IgA2, IgG1, IgG2, IgG3 and IgG4.

Antigen-binding fragments include, inter alia, Fab, F(ab'), F(ab')2, Fv, dAb, Fd, complementarity determining region (CDR) fragments, single-chain antibodies (scFv), bivalent single-chain antibodies, single-chain phage antibodies, diabodies, triabodies, tetrabodies, (poly)peptides that contain at least a fragment of an immunoglobulin that is sufficient to confer specific antigen binding to the (poly)peptide, etc. The above fragments may be produced synthetically or by enzymatic or chemical cleavage of intact immunoglobulins or they may be genetically engineered by recombinant DNA techniques. The methods of production are well known in the art and are described, for example, in Antibodies: A Laboratory Manual, Edited by: E. Harlow and D, Lane (1988), Cold Spring Harbor Laboratory, Cold Spring Harbor, N.Y., which is incorporated herein by reference. A binding molecule or antigen-binding fragment thereof may have one or more binding sites. If there is more than one binding site, the binding sites may be identical to one another or they may be different.

The binding molecule can be a naked or unconjugated binding molecule but can also be part of an immunoconjugate. A naked or unconjugated binding molecule is intended to refer to a binding molecule that is not conjugated, operatively linked or otherwise physically or functionally associated with an effector moiety or tag, such as inter alia a toxic substance, a radioactive substance, a liposome, an enzyme. It will be understood that naked or unconjugated binding molecules do not exclude binding molecules that have been stabilized, multimerized, humanized or in any other way manipulated, other than by the attachment of an effector moiety or tag. Accordingly, all post-translationally modified naked and unconjugated binding molecules are included herewith, including where the modifications are made in the natural binding molecule-producing cell environment, by a recombinant binding molecule-producing cell, and are introduced by the hand of man after initial binding molecule preparation. Of course, the term naked or unconjugated binding molecule does not exclude the ability of the binding molecule to form functional associations with effector cells and/or molecules after administration to the body, as some of such interactions are necessary in order to exert a biological effect. The lack of associated effector group or tag is therefore applied in definition to the naked or unconjugated binding molecule in vitro, not in vivo.

As used herein, the term "biological sample" encompasses a variety of sample types, including blood and other liquid samples of biological origin, solid tissue samples such as a biopsy specimen or tissue cultures, or cells derived there from and the progeny thereof. The term also includes samples that have been manipulated in any way after their procurement, such as by treatment with reagents, solubilization, or enrichment for certain components, such as proteins or polynucleotides. The term encompasses various kinds of clinical samples obtained from any species, and also includes cells in culture, cell supernatants and cell lysates.

The term "complementarity determining regions" (CDR) as used herein means sequences within the variable regions of binding molecules, such as immunoglobulins, that usually contribute to a large extent to the antigen binding site which is complementary in shape and charge distribution to the epitope recognized on the antigen. The CDR regions can be specific for linear epitopes, discontinuous epitopes, or conformational epitopes of proteins or protein fragments, either as present on the protein in its native conformation or, in some cases, as present on the proteins as denatured, e.g., by solubilization in SDS. Epitopes may also consist of posttranslational modifications of proteins.

The term "deletion", as used herein, denotes a change in either amino acid or nucleotide sequence in which one or more amino acid or nucleotide residues, respectively, are absent as compared to the parent, often the naturally occurring, molecule.

The term "expression-regulating nucleic acid sequence" as used herein refers to polynucleotide sequences necessary for and/or affecting the expression of an operably linked coding sequence in a particular host organism. The expression-regulating nucleic acid sequences, such as inter alia appropriate transcription initiation, termination, promoter, enhancer sequences; repressor or activator sequences; efficient RNA processing signals such as splicing and polyadenylation signals; sequences that stabilize cytoplasmic mRNA; sequences that enhance translation efficiency (e.g., ribosome binding sites); sequences that enhance protein stability; and when desired, sequences that enhance protein secretion, can be any nucleic acid sequence showing activity in the host organism of choice and can be derived from genes encoding proteins, which are either homologous or heterologous to the host organism. The identification and employment of expression-regulating sequences is routine to the person skilled in the art.

The term "functional variant", as used herein, refers to a binding molecule that comprises a nucleotide and/or amino acid sequence that is altered by one or more nucleotides and/or amino acids compared to the nucleotide and/or amino acid sequences of the parental binding molecule and that is still capable of competing for binding to the binding partner, e.g. H5N1, with the parental binding molecule. In other words, the modifications in the amino acid and/or nucleotide sequence of the parental binding molecule do not significantly affect or alter the binding characteristics of the binding molecule encoded by the nucleotide sequence or containing the amino acid sequence, i.e. the binding molecule is still able to recognize and bind its target. The functional variant may have conservative sequence modifications including nucleotide and amino acid substitutions, additions and deletions. These modifications can be introduced by standard techniques known in the art, such as site-directed mutagenesis and random PCR-mediated mutagenesis, and may comprise natural as well as non-natural nucleotides and amino acids.

Conservative amino acid substitutions include the ones in which the amino acid residue is replaced with an amino acid residue having similar structural or chemical properties. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., asparagine, glutamine, serine, threonine, tyrosine, cysteine, tryptophan), non-polar side chains (e.g., glycine, alanine, valine, leucine, isoleucine, proline, phenylalanine, methionine), beta-branched side chains (e.g., threonine, valine, isoleucine) and aromatic side chains (e.g., tyrosine, phenylalanine, tryptophan). It will be clear to the skilled artisan that other classifications of amino acid residue families than the one used above can also be employed. Furthermore, a variant may have non-conservative amino acid substitutions, e.g., replacement of an amino acid with an amino acid residue having different structural or chemical properties. Similar minor variations may also include amino acid deletions or insertions, or both. Guidance in determining which amino acid residues may be substituted, inserted, or deleted without abolishing immunological activity may be found using computer programs well known in the art.

A mutation in a nucleotide sequence can be a single alteration made at a locus (a point mutation), such as transition or transversion mutations, or alternatively, multiple nucleotides may be inserted, deleted or changed at a single locus. In addition, one or more alterations may be made at any number of loci within a nucleotide sequence. The mutations may be performed by any suitable method known in the art.

The term "host", as used herein, is intended to refer to an organism or a cell into which a vector such as a cloning vector or an expression vector has been introduced. The organism or cell can be prokaryotic or eukaryotic. It should be understood that this term is intended to refer not only to the particular subject organism or cell but to the progeny of such an organism or cell as well. Because certain modifications may occur in succeeding generations due to either mutation or environmental influences, such progeny may not, in fact, be identical to the parent organism or cell, but are still included within the scope of the term "host" as used herein.

The term "human", when applied to binding molecules as defined herein, refers to molecules that are either directly derived from a human or based upon a human sequence. When a binding molecule is derived from or based on a human sequence and subsequently modified, it is still to be considered human as used throughout the specification. In other words, the term human, when applied to binding molecules is intended to include binding molecules having variable and constant regions derived from human germline immunoglobulin sequences or based on variable or constant regions occurring in a human or human lymphocyte and modified in some form. Thus, the human binding molecules may include amino acid residues not encoded by human germline immunoglobulin sequences, comprise substitutions and/or deletions (e.g., mutations introduced by for instance random or site-specific mutagenesis in vitro or by somatic mutation in vivo). "Based on" as used herein refers to the situation that a nucleic acid sequence may be exactly copied from a template, or with minor mutations, such as by error-prone PCR methods, or synthetically made matching the template exactly or with minor modifications. Semi-synthetic molecules based on human sequences are also considered to be human as used herein.

The term "insertion", also known as the term "addition", denotes a change in an amino acid or nucleotide sequence resulting in the addition of one or more amino acid or nucleotide residues, respectively, as compared to the parent sequence.

The term "isolated", when applied to binding molecules as defined herein, refers to binding molecules that are substantially free of other proteins or polypeptides, particularly free of other binding molecules having different antigenic specificities, and are also substantially free of other cellular material and/or chemicals. For example, when the binding molecules are recombinantly produced, they are preferably substantially free of culture medium, and when the binding molecules are produced by chemical synthesis, they are preferably substantially free of chemical precursors or other chemicals, i.e., they are separated from chemical precursors or other chemicals which are involved in the synthesis of the protein. The term "isolated" when applied to nucleic acid molecules encoding binding molecules as defined herein, is intended to refer to nucleic acid molecules in which the nucleotide sequences encoding the binding molecules are free of other nucleotide sequences, particularly nucleotide sequences encoding binding molecules that bind binding partners other than H5N1. Furthermore, the term "isolated" refers to nucleic acid molecules that are substantially separated from other cellular components that naturally accompany the native nucleic acid molecule in its natural host, e.g., ribosomes, polymerases, or genomic sequences with which it is naturally associated. Moreover, "isolated" nucleic acid molecules, such as cDNA molecules, can be substantially free of other cellular material, or culture medium when produced by recombinant techniques, or substantially free of chemical precursors or other chemicals when chemically synthesized.

The term "monoclonal antibody" as used herein refers to a preparation of antibody molecules of single molecular composition. A monoclonal antibody displays a single binding specificity and affinity for a particular epitope. Accordingly, the term "human monoclonal antibody" refers to an antibody displaying a single binding specificity which has variable and constant regions derived from or based on human germline immunoglobulin sequences or derived from completely synthetic sequences. The method of preparing the monoclonal antibody is not relevant.

The term "naturally occurring" as used herein as applied to an object refers to the fact that an object can be found in nature. For example, a polypeptide or polynucleotide sequence that is present in an organism that can be isolated from a source in nature and which has not been intentionally modified by man in the laboratory is naturally occurring.

The term "nucleic acid molecule" as used in the present invention refers to a polymeric form of nucleotides and includes both sense and anti-sense strands of RNA, cDNA, genomic DNA, and synthetic forms and mixed polymers of the above. A nucleotide refers to a ribonucleotide, deoxynucleotide or a modified form of either type of nucleotide. The term also includes single- and double-stranded forms of DNA. In addition, a polynucleotide may include either or both naturally occurring and modified nucleotides linked together by naturally occurring and/or non-naturally occurring nucleotide linkages. The nucleic acid molecules may be modified chemically or biochemically or may contain non-natural or derivatized nucleotide bases, as will be readily appreciated by those of skill in the art. Such modifications include, for example, labels, methylation, substitution of one or more of the naturally occurring nucleotides with an analog, internucleotide modifications such as uncharged linkages (e.g., methyl phosphonates, phosphotriesters, phosphoramidates, carbamates, etc.), charged linkages (e.g., phosphorothioates, phosphorodithioates, etc.), pendent moieties (e.g., polypeptides), intercalators (e.g., acridine, psoralen, etc.), chelators, alkylators, and modified linkages (e.g., alpha anomeric nucleic acids, etc.). The above term is also intended to include any topological conformation, including single-stranded, double-stranded, partially duplexed, triplex, hair-pinned, circular and padlocked conformations. Also included are synthetic molecules that mimic polynucleotides in their ability to bind to a designated sequence via hydrogen bonding and other chemical interactions. Such molecules are known in the art and include, for example, those in which peptide linkages substitute for phosphate linkages in the backbone of the molecule. A reference to a nucleic acid sequence encompasses its complement unless otherwise specified. Thus, a reference to a nucleic acid molecule having a particular sequence should be understood to encompass its complementary strand, with its complementary sequence. The complementary strand is also useful, e.g., for anti-sense therapy, hybridisation probes and PCR primers.

The term "operably linked" refers to two or more nucleic acid sequence elements that are usually physically linked and are in a functional relationship with each other. For instance, a promoter is operably linked to a coding sequence, if the promoter is able to initiate or regulate the transcription or expression of a coding sequence, in which case the coding sequence should be understood as being "under the control of" the promoter.

By "pharmaceutically acceptable excipient" is meant any inert substance that is combined with an active molecule such as a drug, agent, or binding molecule for preparing an agreeable or convenient dosage form. The "pharmaceutically acceptable excipient" is an excipient that is non-toxic to recipients at the dosages and concentrations employed, and is compatible with other ingredients of the formulation comprising the drug, agent or binding molecule. Pharmaceutically acceptable excipients are widely applied in the art.

The term "specifically binding", as used herein, in reference to the interaction of a binding molecule, e.g. an antibody, and its binding partner, e.g. an antigen, means that the interaction is dependent upon the presence of a particular structure, e.g. an antigenic determinant or epitope, on the binding partner. In other words, the antibody preferentially binds or recognizes the binding partner even when the binding partner is present in a mixture of other molecules or organisms. The binding may be mediated by covalent or non-covalent interactions or a combination of both. In yet other words, the term "specifically binding" means immunospecifically binding to an antigen or a fragment thereof and not immunospecifically binding to other antigens. A binding molecule that immunospecifically binds to an antigen may bind to other peptides or polypeptides with lower affinity as determined by, e.g., radio-immunoassays (RIA), enzyme-linked immunosorbent assays (ELISA), BIACORE, or other assays known in the art. Binding molecules or fragments thereof that immunospecifically bind to an antigen may be cross-reactive with related antigens. Preferably, binding molecules or fragments thereof that immunospecifically bind to an antigen do not cross-react with other antigens.

A "substitution", as used herein, denotes the replacement of one or more amino acids or nucleotides by different amino acids or nucleotides, respectively.

The term "therapeutically effective amount" refers to an amount of the binding molecule as defined herein that is effective for preventing, ameliorating and/or treating a condition resulting from infection with H5N1.

The term "treatment" refers to therapeutic treatment as well as prophylactic or preventative measures to cure or halt or at least retard disease progress. Those in need of treatment include those already inflicted with a condition resulting from infection with H5N1 as well as those in which infection with H5N1 is to be prevented. Subjects partially or totally recovered from infection with H5N1 might also be in need of treatment. Prevention encompasses inhibiting or reducing the spread of H5N1 or inhibiting or reducing the onset, development or progression of one or more of the symptoms associated with infection with H5N1.

The term "vector" denotes a nucleic acid molecule into which a second nucleic acid molecule can be inserted for introduction into a host where it will be replicated, and in some cases expressed. In other words, a vector is capable of transporting a nucleic acid molecule to which it has been linked. Cloning as well as expression vectors are contemplated by the term "vector", as used herein. Vectors include, but are not limited to, plasmids, cosmids, bacterial artificial chromosomes (BAC) and yeast artificial chromosomes (YAC) and vectors derived from bacteriophages or plant or animal (including human) viruses. Vectors comprise an origin of replication recognized by the proposed host and in case of expression vectors, promoter and other regulatory regions recognized by the host. A vector containing a second nucleic acid molecule is introduced into a cell by transformation, transfection, or by making use of viral entry mechanisms. Certain vectors are capable of autonomous replication in a host into which they are introduced (e.g., vectors having a bacterial origin of replication can replicate in bacteria). Other vectors can be integrated into the genome of a host upon introduction into the host, and thereby are replicated along with the host genome.

SUMMARY OF THE INVENTION

The invention provides human binding molecules capable of specifically binding to influenza virus H5N1 and exhibiting neutralizing activity against H5N1. The invention also provides binding molecules that bind to an epitope in the haemagglutinin protein that is shared between influenza subtypes and therefore relates to binding molecules that cross-react between H5-, H1-, H2-, H6- and H9 influenza based subtypes, such as H5N1, H1N1 and other influenza strains that contain the HA protein with these particular epitopes. The invention also pertains to nucleic acid molecules encoding at least the binding region of the human binding molecules. The invention further provides for the use of the human binding molecules of the invention in the prophylaxis and/or treatment of a subject having, or at risk of developing, an H5N1 infection. Besides that, the invention pertains to the use of the human binding molecules of the invention in the diagnosis/detection of H5N1.

DETAILED DESCRIPTION

In a first aspect the present invention encompasses binding molecules capable of specifically binding to influenza virus A, particularly influenza virus A subtype H5N1. Preferably, the binding molecules are human binding molecules. Preferably, the binding molecules of the invention exhibit neutralizing activity against influenza virus A subtype H5N1. In a further aspect the binding molecules of the invention are capable of specifically binding to and/or have neutralizing activity against different influenza virus H5N1 strains. These strains may be a member of influenza virus H5N1 strains of clade 1, clade 2 or clade 3. Phylogenetic analyses of the HA genes from the 2004 and 2005 H5N1 outbreak showed two different lineages of HA genes, termed clades 1 and 2. Viruses in each of these clades are distributed in non-overlapping geographic regions of Asia. The H5N1 viruses from the Indochina peninsula are tightly clustered within clade 1, whereas H5N1 isolates from several surrounding countries are distinct from clade 1 isolates and belong in the more divergent clade 2. Clade 1 H5N1 viruses were isolated from humans and birds in Vietnam, Thailand, and Cambodia, but only from birds in Laos and Malaysia. The clade 2 viruses were found in viruses isolated exclusively from birds in China, Indonesia, Japan, and South Korea. Viruses isolated from birds and humans in Hong Kong in 2003 and 1997 made up clades 1 (also categorized in clade 1) and 3, respectively (see WHO Global Influenza Program Surveillance Network, 2005). The hemagglutinins of the clades differ in their amino acid sequences. Examples of clade 1 strains include, but are not limited to, A/Hong Kong/213/03, A/Vietnam/1194/04, A/Vietnam/1203/04 and A/Thailand/1(KAN-1)/2004. Examples of clade 2 strains include, but are not limited to, A/Indonesia/5/05, A/bar headed goose/Qinghai/1A/05, A/turkey/Turkey/1/05 and A/Anhui/1/05. Examples of clade 3 strains include, but are not limited to, A/Hong Kong/156/97 and A/goose/Guangdong/1/96. Other strains can be found, e.g., in WHO Global Influenza Program Surveillance Network, 2005 and on http://www.who.int/csr/disease/avian_influenza/guidelines/recommendationvaccine.pdf Preferably, the binding molecules of the invention are capable of specifically binding to and have neutralizing activity against clade 1, clade 2 and clade 3 strains. The binding molecules of the invention may be capable of specifically binding to influenza virus H5N1 that are viable, living and/or infective or that are in inactivated/attenuated form. Methods for inactivating/attenuating influenza virus H5N1 are well known in the art and include, but are not limited to, treatment with formalin, β-propiolactone (BPL), merthiolate, and/or ultraviolet light.

The binding molecules of the invention may also be capable of specifically binding to one or more fragments of influenza virus H5N1 such as inter alia a preparation of one or more proteins and/or (poly)peptides derived from subtype H5N1 or one or more recombinantly produced proteins and/or polypeptides of H5N1. For methods of treatment and/or prevention of H5N1 infections the binding molecules are preferably capable of specifically binding to surface accessible proteins of H5N1 such as the surface glycoproteins, hemagglutinin (HA) and neuraminidase (NA), which are required for viral attachment and cellular release, or membrane proteins (M1 and M2). In a specific embodiment the binding molecules of the invention are capable of specifically binding to the HA molecule of H5N1 strains. They may be capable of specifically binding to the HA1 and/or HA2 subunit of the HA molecule. They may be capable of specifically binding to linear or structural and/or conformational epitopes on the HA1 and/or HA2 subunit of the HA molecule. The HA molecule may be purified from viruses or recombinantly produced and optionally isolated before use. Alternatively, HA may be expressed on the surface of cells.

For diagnostical purposes the binding molecules may also be capable of specifically binding to proteins not present on the surface of H5N1 including the nucleoprotein, the nucleocapsid structural protein, polymerases (PA, PB and PB2), and non-structural proteins (NS1 and NS2). The nucleotide and/or amino acid sequence of proteins of various H5N1 strains can be found in the GenBank-database, NCBI Influenza Virus Sequence Database, Influenza Sequence Database (ISD), EMBL-database and/or other databases. It is well within the reach of the skilled person to find such sequences in the respective databases.

In another embodiment the binding molecules of the invention are capable of specifically binding to a fragment of the above-mentioned proteins and/or polypeptides, wherein the fragment at least comprises an antigenic determinant recognized by the binding molecules of the invention. An "antigenic determinant" as used herein is a moiety that is capable of binding to a binding molecule of the invention with sufficiently high affinity to form a detectable antigen-binding molecule complex. The binding molecules of the invention may or may not be capable of specifically binding to the extracellular part of HA (also called herein soluble HA (sHA)).

The binding molecules of the invention can be intact immunoglobulin molecules such as polyclonal or monoclonal antibodies or the binding molecules can be antigen-binding fragments including, but not limited to, Fab, F(ab'), F(ab')$_2$, Fv, dAb, Fd, complementarity determining region (CDR) fragments, single-chain antibodies (scFv), bivalent single-chain antibodies, single-chain phage antibodies, diabodies, triabodies, tetrabodies, and (poly)peptides that contain at least a fragment of an immunoglobulin that is sufficient to confer specific antigen binding to influenza virus H5N1 strains or a fragment thereof. In a preferred embodiment the binding molecules of the invention are human monoclonal antibodies.

The binding molecules of the invention can be used in non-isolated or isolated form. Furthermore, the binding molecules of the invention can be used alone or in a mixture comprising at least one binding molecule (or variant or fragment thereof) of the invention. In other words, the binding molecules can be used in combination, e.g., as a pharmaceutical composition comprising two or more binding molecules of the invention, variants or fragments thereof. For example, binding molecules having different, but complementary activities can be combined in a single therapy to achieve a desired prophylactic, therapeutic or diagnostic effect, but alternatively, binding molecules having identical activities can also be combined in a single therapy to achieve a desired prophylactic, therapeutic or diagnostic effect. Optionally, the mixture further comprises at least one other therapeutic agent. Preferably, the therapeutic agent such as, e.g., M2 inhibitors (e.g., amantidine, rimantadine) and/or neuraminidase inhibitors (e.g., zanamivir, oseltamivir) is useful in the prophylaxis and/or treatment of an influenza virus H5N1 infection.

Typically, binding molecules according to the invention can bind to their binding partners, i.e. influenza virus H5N1 or fragments thereof, with an affinity constant ($K_d$-value) that is lower than $0.2 \times 10^{-4}$ M, $1.0 \times 10^{-5}$ M, $10.0 \times 10^{-6}$ M, $1.0 \times 10^{-7}$ M, preferably lower than $1.0 \times 10^{-8}$ M, more preferably lower than $1.0 \times 10^{-9}$ M, more preferably lower than $1.0 \times 10^{-10}$ M, even more preferably lower than $1.0 \times 10^{-11}$ M, and in particular lower than $1.10 \times 10^{-12}$ M. The affinity constants can vary for antibody isotypes. For example, affinity binding for an IgM isotype refers to a binding affinity of at least about $1.0 \times 10^{-7}$ M. Affinity constants can for instance be measured using surface plasmon resonance, for example using the BIA-CORE system (Pharmacia Biosensor AB, Uppsala, Sweden).

The binding molecules according to the invention may bind to influenza virus H5N1 or a fragment thereof in soluble form such as for instance in a sample or in suspension or may bind to influenza virus H5N1 or a fragment thereof bound or attached to a carrier or substrate, e.g., microtiter plates, membranes and beads, etc. Carriers or substrates may be made of glass, plastic (e.g., polystyrene), polysaccharides, nylon, nitrocellulose, or Teflon, etc. The surface of such supports may be solid or porous and of any convenient shape. Furthermore, the binding molecules may bind to influenza virus H5N1 in purified/isolated or non-purified/non-isolated form.

The binding molecules of the invention exhibit neutralizing activity. Neutralizing activity can for instance be measured as described herein. Alternative assays measuring neutralizing activity are described in for instance WHO Manual on Animal Influenza Diagnosis and Surveillance, Geneva: World Health Organisation, 2005, version 2002.5. The present invention relates to an isolated human binding molecule that is able to recognize and bind to an epitope in the HA2 subunit of the influenza haemagglutinin protein (HA), characterized in that said binding molecule has neutralizing activity against an influenza virus comprising HA of the H5 subtype. Examples of influenza strains that contain such a HA of the H5 subtype and that are important strains in view of pandemic threats are H5N1, H5N2, H5N8, and H5N9. Particularly preferred are binding molecules that at least neutralize the H5N1 influenza strain. Preferably, said binding molecule according to the invention does not depend on an epitope in the HA1 subunit of the HA protein for binding to said HA protein. The known murine antibody that was described in the art (C179) that also binds to the same epitope in the HA2 domain also depends on binding to an epitope in the HA1 domain of the HA protein. This is disadvantageous as it adds to the possibility of escape mutants that are no longer recognized by the antibody. Moreover, a number of the antibodies of the present invention (such as CR6307 and CR6323) do not depend on conformational epitopes and recognize the HA2 epitope even in a reduced form (when used in western-blotting). This is an advantage over the antibodies from the art because when a conformational change is induced in the HA protein due to whatever mutation in another part of the protein, such conformational change will not most likely hamper the binding of the antibodies of the present invention to the HA2 epitope, whereas antibodies that do depend on conformation might very well be unable to bind when such mutations occur.

In another preferred embodiment, the binding molecule according to the invention also has neutralizing activity against an influenza virus comprising HA of the H1 subtype, and preferably wherein said binding molecule also has neutralizing activity against an influenza virus comprising HA of the H2, H6 and/or H9 subtype. It has been shown herein that the binding molecules of the present invention interact with an epitope present in the HA2 epitopes present in the H5, H1, H2, H6, and H9 subtypes, and it has been shown that the binding molecules of the present invention cross-neutralize between influenza subtypes because of this epitope-sharing. It is concluded that the binding molecules of the present invention that depend on binding to that particular part in the HA2 domain (and not on another—mutational prone—epitope in HA1) can cross-neutralize between influenza virus subtypes as they do not appear to depend on binding to domains within HA1, which may be altered significantly due to antigenic drifts. The skilled person, based on what has been disclosed herein, can now determine whether an antibody indeed cross-reacts with HA proteins from different subtypes and also determine whether they are able to neutralize influenza viruses of different subtypes in vivo.

In another preferred aspect of the invention the binding molecule of the present invention binds to an epitope in the HA2 subunit that is selected from the group consisting of amino acid sequence: GVTNKVNSIIDK (SEQ ID NO:368), GVTNKVNSIINK (SEQ ID NO:369), GVTNKENSIIDK (SEQ ID NO:370), GVTNKVNRIIDK (SEQ ID NO:371), GITNKVNSVIEK (SEQ ID NO:372), GITNKENSVIEK (SEQ ID NO:373), GITNKVNSIIDK (SEQ ID NO:374), and KITSKVNNIVDK (SEQ ID NO:375). As can be concluded from the data shown in Table 13, certain binding molecules of the present invention, CR6261, CR6325, and CR6329 interact with the GVTNKVNSIIDK (SEQ ID NO:368) epitope present in H5N1, and are not hampered by a mutation in the TGLRN epitope in HA1 that do influence the binding of C179. Moreover, some binding molecules, such as CR6307 and CR6323 are not even hampered by a escape mutant, as disclosed in Okuno et al. (1993) with a valine->glutamic acid mutation at position 6 (exemplified by GVTNKENSIIDK (SEQ ID NO:370)). This epitope is part of an extended alpha helix in the HA2 region. The residues in this putative epitope that are predicted to be most solvent exposed are underlined in bold: GVTNKENSIIDK (SEQ ID NO:370). These amino acids would be most accessible to a binding molecule and thus may form the most important region of the epitope. Consistent with this notion the highlighted amino acids are absolutely conserved in identity and position in all the sequences presented. This knowledge could be used to predict binding epitopes in influenza subtypes that do not carry the same sequence as above (i.e. H3, H7 and B strains).

Preferred is a binding molecule according to the present invention that is selected from the group consisting of:
a) a binding molecule comprising a heavy chain CDR1 region of SEQ ID NO:1, a heavy chain CDR2 region of SEQ ID NO:2, and a heavy chain CDR3 region of SEQ ID NO:3,
b) a binding molecule comprising a heavy chain CDR1 region of SEQ ID NO:16, a heavy chain CDR2 region of SEQ ID NO:17, and a heavy chain CDR3 region of SEQ ID NO:18,
c) a binding molecule comprising a heavy chain CDR1 region of SEQ ID NO:1, a heavy chain CDR2 region of SEQ ID NO:22, and a heavy chain CDR3 region of SEQ ID NO:23,
d) a binding molecule comprising a heavy chain CDR1 region of SEQ ID NO:27, a heavy chain CDR2 region of SEQ ID NO:28, and a heavy chain CDR3 region of SEQ ID NO:29,
e) a binding molecule comprising a heavy chain CDR1 region of SEQ ID NO:39, a heavy chain CDR2 region of SEQ ID NO:40, and a heavy chain CDR3 region of SEQ ID NO:41,
f) a binding molecule comprising a heavy chain CDR1 region of SEQ ID NO:45, a heavy chain CDR2 region of SEQ ID NO:46, and a heavy chain CDR3 region of SEQ ID NO:47,
g) a binding molecule comprising a heavy chain CDR1 region of SEQ ID NO:1, a heavy chain CDR2 region of SEQ ID NO:49, and a heavy chain CDR3 region of SEQ ID NO:50,
h) a binding molecule comprising a heavy chain CDR1 region of SEQ ID NO:52, a heavy chain CDR2 region of SEQ ID NO:53, and a heavy chain CDR3 region of SEQ ID NO:54,
i) a binding molecule comprising a heavy chain CDR1 region of SEQ ID NO:262, a heavy chain CDR2 region of SEQ ID NO:263, and a heavy chain CDR3 region of SEQ ID NO:264,
j) a binding molecule comprising a heavy chain CDR1 region of SEQ ID NO:268, a heavy chain CDR2 region of SEQ ID NO:269, and a heavy chain CDR3 region of SEQ ID NO:270,
k) a binding molecule comprising a heavy chain CDR1 region of SEQ ID NO:274, a heavy chain CDR2 region of SEQ ID NO:275, and a heavy chain CDR3 region of SEQ ID NO:276, l) a binding molecule comprising a heavy chain CDR1 region of SEQ ID NO:280, a heavy chain CDR2 region of SEQ ID NO:281, and a heavy chain CDR3 region of SEQ ID NO:282,
m) a binding molecule comprising a heavy chain CDR1 region of SEQ ID NO:286, a heavy chain CDR2 region of SEQ ID NO:287, and a heavy chain CDR3 region of SEQ ID NO:288,
n) a binding molecule comprising a heavy chain CDR1 region of SEQ ID NO:292, a heavy chain CDR2 region of SEQ ID NO:293, and a heavy chain CDR3 region of SEQ ID NO:294,
o) a binding molecule comprising a heavy chain CDR1 region of SEQ ID NO:304, a heavy chain CDR2 region of SEQ ID NO:305, and a heavy chain CDR3 region of SEQ ID NO:306, and
p) a binding molecule comprising a heavy chain CDR1 region of SEQ ID NO:310, a heavy chain CDR2 region of SEQ ID NO:311, and a heavy chain CDR3 region of SEQ ID NO:312.

In a preferred embodiment, the binding molecule according to the invention is for a use as a medicament and preferably for the diagnostic, therapeutic and/or prophylactic treatment of influenza infection. In one aspect of such use, said influenza infection is caused by an influenza virus that is associated with a pandemic outbreak, or has the potential to be associated with a pandemic outbreak (see WO 2007/045674 and the tables therein). Preferably, the influenza virus strain that is associated with a pandemic outbreak and wherein the disease caused by these strains can be treated by the binding molecules of the present invention, is selected from the group consisting of H1N1, H5N1, H5N2, H5N8, H5N9, H2-based viruses, and H9N2.

The present invention also relates to a pharmaceutical composition comprising a binding molecule according to the invention, and a pharmaceutically acceptable excipient.

In yet another embodiment the invention relates to a use of a binding molecule according to the invention in the preparation of a medicament for the diagnosis, prophylaxis, and/or treatment of an influenza virus infection. Such infections can occur in small populations, but can also spread around the world in seasonal epidemics or, worse, in global pandemics where millions of individuals are at risk. The invention provides binding molecules that can neutralize the infection of influenza strains that cause such seasonal epidemics as well as potential pandemics. Importantly, protection and treatment can be envisioned now with the binding molecules of the present invention in relation to multiple influenza strains as it has been disclosed that due to the binding of an epitope that is shared between HA proteins of different influenza strains, cross-neutralization between such strains is now possible by using the binding molecules of the present invention. This is highly advantageous as the binding molecules can protect mammals when they are administered either before or after infection (as disclosed in the examples), and therefore also when it is unclear (in early stages of occurrence) whether the infection is caused by an H1, an H2, an H5, an H6 or an H9-based strain. Health workers, military forces as well as the general population may be treated prophylactically, or treated upon infection, with the binding molecules of the present invention. Potentially, the binding molecules of the present invention can be prepared and stored in huge stocks because it will provide protection against different pandemic strains, and this will be beneficial in the preparedness of possible influenza pandemics in the future.

In a preferred embodiment, the human binding molecules according to the invention are characterized in that the human binding molecules are selected from the group consisting of: a) a human binding molecule comprising a heavy chain CDR1 region having the amino acid sequence of SEQ ID NO:1, a heavy chain CDR2 region having the amino acid sequence of SEQ ID NO:2, a heavy chain CDR3 region having the amino acid sequence of SEQ ID NO:3, a light chain CDR1 region having the amino acid sequence of SEQ ID NO:4, a light chain CDR2 region having the amino acid sequence of SEQ ID NO:5, and a light chain CDR3 region having the amino acid sequence of SEQ ID NO:6, b) a human binding molecule comprising a heavy chain CDR1 region having the amino acid sequence of SEQ ID NO:1, a heavy chain CDR2 region having the amino acid sequence of SEQ ID NO:2, a heavy chain CDR3 region having the amino acid sequence of SEQ ID NO:3, a light chain CDR1 region having the amino acid sequence of SEQ ID NO:7, a light chain CDR2 region having the amino acid sequence of SEQ ID NO:8, and a light chain CDR3 region having the amino acid sequence of SEQ ID NO:9, c) a human binding molecule comprising a heavy chain CDR1 region having the amino acid sequence of SEQ ID NO:1, a heavy chain CDR2 region having the amino acid sequence of SEQ ID NO:2, a heavy chain CDR3 region having the amino acid sequence of SEQ ID NO:3, a light chain CDR1 region having the amino acid sequence of SEQ ID NO:10, a light chain CDR2 region having the amino acid sequence of SEQ ID NO:11, and a light chain CDR3 region having the amino acid sequence of SEQ ID NO:12, d) a human binding molecule comprising a heavy chain CDR1 region having the amino acid sequence of SEQ ID NO:1, a heavy chain CDR2 region having the amino acid sequence of SEQ ID NO:2, a heavy chain CDR3 region having the amino acid sequence of SEQ ID NO:3, a light chain CDR1 region having the amino acid sequence of SEQ ID NO:13, a light chain CDR2 region having the amino acid sequence of SEQ ID NO:14, and a light chain CDR3 region having the amino acid sequence of SEQ ID NO:15, e) a human binding molecule comprising a heavy chain CDR1 region having the amino acid sequence of SEQ ID NO:16, a heavy chain CDR2 region having the amino acid sequence of SEQ ID NO:17, a heavy chain CDR3 region having the amino acid sequence of SEQ ID NO:18, a light chain CDR1 region having the amino acid sequence of SEQ ID NO:19, a light chain CDR2 region having the amino acid sequence of SEQ ID NO:20, and a light chain CDR3 region having the amino acid sequence of SEQ ID NO:21, f) a human binding molecule comprising a heavy chain CDR1 region having the amino acid sequence of SEQ ID NO:1, a heavy chain CDR2 region having the amino acid sequence of SEQ ID NO:22, a heavy chain CDR3 region having the amino acid sequence of SEQ ID NO:23, a light chain CDR1 region having the amino acid sequence of SEQ ID NO:24, a light chain CDR2 region having the amino acid sequence of SEQ ID NO:25, and a light chain CDR3 region having the amino acid sequence of SEQ ID NO:26, g) a human binding molecule comprising a heavy chain CDR1 region having the amino acid sequence of SEQ ID NO:27, a heavy chain CDR2 region having the amino acid sequence of SEQ ID NO:28, a heavy chain CDR3 region having the amino acid sequence of SEQ ID NO:29, a light chain CDR1 region having the amino acid sequence of SEQ ID NO:30, a light chain CDR2 region having the amino acid sequence of SEQ ID NO:31, and a light chain CDR3 region having the amino acid sequence of SEQ ID NO:32, h) a human binding molecule comprising a heavy chain CDR1 region having the amino acid sequence of SEQ ID NO:1, a heavy chain CDR2 region having the amino acid sequence of SEQ ID NO:2, a heavy chain CDR3 region having the amino acid sequence of SEQ ID NO:3, a light chain CDR1 region having the amino acid sequence of SEQ ID NO:33, a light chain CDR2 region having the amino acid sequence of SEQ ID NO:34, and a light chain CDR3 region having the amino acid sequence of SEQ ID NO:35, i) a human binding molecule comprising a heavy chain CDR1 region having the amino acid sequence of SEQ ID NO:1, a heavy chain CDR2 region having the amino acid sequence of SEQ ID NO:2, a heavy chain CDR3 region having the amino acid sequence of SEQ ID NO:3, a light chain CDR1 region having the amino acid sequence of SEQ ID NO:36, a light chain CDR2 region having the amino acid sequence of SEQ ID NO:37, and a light chain CDR3 region having the amino acid sequence of SEQ ID NO:38, j) a human binding molecule comprising a heavy chain CDR1 region having the amino acid sequence of SEQ ID NO:39, a heavy chain CDR2 region having the amino acid sequence of SEQ ID NO:40, a heavy chain CDR3 region having the amino acid sequence of SEQ ID NO:41, a light chain CDR1 region having the amino acid sequence of SEQ ID NO:42, a light chain CDR2 region having the amino acid sequence of SEQ ID NO:43, and a light chain CDR3 region having the amino acid sequence of SEQ ID NO:44, k) a human binding molecule comprising a heavy chain CDR1 region having the amino acid sequence of SEQ ID NO:45, a heavy chain CDR2 region having the amino acid sequence of SEQ ID NO:46, a heavy chain CDR3 region having the amino acid sequence of SEQ ID NO:47, a light chain CDR1 region having the amino acid sequence of SEQ ID NO:7, a light chain CDR2 region having the amino acid sequence of SEQ ID NO:8, and a light chain CDR3 region having the amino acid sequence of SEQ ID NO:48, l) a human binding molecule comprising a heavy chain CDR1 region having the amino acid sequence of SEQ ID NO:1, a heavy chain CDR2 region having the amino acid sequence of SEQ ID NO:49, a heavy chain CDR3 region having the amino acid sequence of SEQ ID NO:50, a light chain CDR1 region having the amino acid sequence of SEQ ID NO:33, a light chain CDR2 region having the amino acid sequence of SEQ ID NO:34, and a light chain CDR3 region having the amino acid sequence of SEQ ID NO:51, m) a human binding molecule comprising a heavy chain CDR1 region having the amino acid sequence of SEQ ID NO:52, a heavy chain CDR2 region having the amino acid sequence of SEQ ID NO:53, a heavy chain CDR3 region having the amino acid sequence of SEQ ID NO:54, a light chain CDR1 region having the amino acid sequence of SEQ ID NO:55, a light chain CDR2 region having the amino acid sequence of SEQ ID NO:56, and a light chain CDR3 region having the amino acid sequence of SEQ ID NO:57, n) a human binding molecule comprising a heavy chain CDR1 region having the amino acid sequence of SEQ ID NO:262, a heavy chain CDR2 region having the amino acid sequence of SEQ ID NO:263, a heavy chain CDR3 region having the amino acid sequence of SEQ ID NO:264, a light chain CDR1 region having the amino acid sequence of SEQ ID NO:265, a light chain CDR2 region having the amino acid sequence of SEQ ID NO:266, and a light chain CDR3 region having the amino acid sequence of SEQ ID NO:267, o) a human binding molecule comprising a heavy chain CDR1 region having the amino acid sequence of SEQ ID NO:268, a heavy chain CDR2 region having the amino acid sequence of SEQ ID NO:269, a heavy chain CDR3 region having the amino acid sequence of SEQ ID NO:270, a light chain CDR1 region having the amino acid sequence of SEQ ID NO:271, a light chain CDR2 region having the amino acid sequence of SEQ ID NO:272, and a light chain CDR3 region having the amino acid sequence of SEQ ID NO:273, p) a human binding molecule comprising a heavy chain CDR1 region having the amino acid sequence of SEQ ID NO:274, a heavy chain CDR2 region having the amino acid sequence of SEQ ID NO:275, a heavy chain CDR3 region having the amino acid sequence of SEQ ID NO:276, a light chain CDR1 region having the amino acid sequence of SEQ ID NO:277, a light chain CDR2 region having the amino acid sequence of SEQ ID NO:278, and a light chain CDR3 region having the amino acid sequence of SEQ ID NO:279, q) a human binding molecule comprising a heavy chain CDR1 region having the amino acid sequence of SEQ ID NO:280, a heavy chain CDR2 region having the amino acid sequence of SEQ ID NO:281, a heavy chain CDR3 region having the amino acid sequence of SEQ ID NO:282, a light chain CDR1 region having the amino acid sequence of SEQ ID NO:283, a light chain CDR2 region having the amino acid sequence of SEQ ID NO:284, and a light chain CDR3 region having the amino acid sequence of SEQ ID NO:285, r) a human binding molecule comprising a heavy chain CDR1 region having the amino acid sequence of SEQ ID NO:286, a heavy chain CDR2 region having the amino acid sequence of SEQ ID NO:287, a heavy chain CDR3 region having the amino acid sequence of SEQ ID NO:288, a light chain CDR1 region having the amino acid sequence of SEQ ID NO:289, a light chain CDR2 region having the amino acid sequence of SEQ ID NO:290, and a light chain CDR3 region having the amino acid sequence of SEQ ID NO:291, s) a human binding molecule comprising a heavy chain CDR1 region having the amino acid sequence of SEQ ID NO:292, a heavy chain CDR2 region having the amino acid sequence of SEQ ID NO:293, a heavy chain CDR3 region having the amino acid sequence of SEQ ID NO:294, a light chain CDR1 region having the amino acid sequence of SEQ ID NO:295, a light chain CDR2 region having the amino acid sequence of SEQ ID NO:296, and a light chain CDR3 region having the amino acid sequence of SEQ ID NO:297, t) a human binding molecule comprising a heavy chain CDR1 region having the amino acid sequence of SEQ ID NO:304, a heavy chain CDR2 region having the amino acid sequence of SEQ ID NO:305, a heavy chain CDR3 region having the amino acid sequence of SEQ ID NO:306, a light chain CDR1 region having the amino acid sequence of SEQ ID NO:307, a light chain CDR2 region having the amino acid sequence of SEQ ID NO:308, and a light chain CDR3 region having the amino acid sequence of SEQ ID NO:309, u) a human binding molecule comprising a heavy chain CDR1 region having the amino acid sequence of SEQ ID NO:310, a heavy chain CDR2 region having the amino acid sequence of SEQ ID NO:311, a heavy chain CDR3 region having the amino acid sequence of SEQ ID NO:312, a light chain CDR1 region having the amino acid sequence of SEQ ID NO:313, a light chain CDR2 region having the amino acid sequence of SEQ ID NO:314, and a light chain CDR3 region having the amino acid sequence of SEQ ID NO:315, v) a human binding molecule comprising a heavy chain CDR1 region having the amino acid sequence of SEQ ID NO:238, a heavy chain CDR2 region having the amino acid sequence of SEQ ID NO:239, a heavy chain CDR3 region having the amino acid sequence of SEQ ID NO:240, a light chain CDR1 region having the amino acid sequence of SEQ ID NO:241, a light chain CDR1 region having the amino acid sequence of SEQ ID NO:242, and a light chain CDR3 region having the amino acid sequence of SEQ ID NO:243, w) a human binding molecule comprising a heavy chain CDR1 region having the amino acid sequence of SEQ ID NO:244, a heavy chain CDR2 region having the amino acid sequence of SEQ ID NO:245, a heavy chain CDR3 region having the amino acid sequence of SEQ ID NO:246, a light chain CDR1 region having the amino acid sequence of SEQ ID NO:247, a light chain CDR2 region having the amino acid sequence of SEQ ID NO:248, and a light chain CDR3 region having the amino acid sequence of SEQ ID NO:249, x) a human binding molecule comprising a heavy chain CDR1 region having the amino acid sequence of SEQ ID NO:250, a heavy chain CDR2 region having the amino acid sequence of SEQ ID NO:251, a heavy chain CDR3 region having the amino acid sequence of SEQ ID NO:252, a light chain CDR1 region having the amino acid sequence of SEQ ID NO:253, a light chain CDR2 region having the amino acid sequence of SEQ ID NO:254, and a light chain CDR3 region having the amino acid sequence of SEQ ID NO:255, y) a human binding molecule comprising a heavy chain CDR1 region having the amino acid sequence of SEQ ID NO:256, a heavy chain CDR2 region having the amino acid sequence of SEQ ID NO:257, a heavy chain CDR3 region having the amino acid sequence of SEQ ID NO:258, a light chain CDR1 region having the amino acid sequence of SEQ ID NO:259, a light chain CDR2 region having the amino acid sequence of SEQ ID NO:260, and a light chain CDR3 region having the amino acid sequence of SEQ ID NO:261, and z) a human binding molecule comprising a heavy chain CDR1 region having the amino acid sequence of SEQ ID NO:298, a heavy chain CDR2 region having the amino acid sequence of SEQ ID NO:299, a heavy chain CDR3 region having the amino acid sequence of SEQ ID NO:300, a light chain CDR1 region having the amino acid sequence of SEQ ID NO:301, a light chain CDR2 region having the amino acid sequence of SEQ ID NO:302, and a light chain CDR3 region having the amino acid sequence of SEQ ID NO:303.

In a specific embodiment the binding molecules of the invention comprise a heavy chain CDR1 region having the amino acid sequence of SEQ ID NO:1, a heavy chain CDR2 region having the amino acid sequence of SEQ ID NO:2, and a heavy chain CDR3 region having the amino acid sequence of SEQ ID NO:3. The CDR regions of the binding molecules of the invention are shown in Table 7. CDR regions are according to Kabat et al. (1991) as described in Sequences of Proteins of Immunological Interest. In an embodiment of the present invention binding molecules may comprise two, three, four, five or all six CDR regions as disclosed herein. Preferably, a binding molecule according to the present invention comprises at least two of the CDRs disclosed herein.

In an embodiment the binding molecules of the invention comprise the VH germline VH1-69 (see Tomlinson 1M, Williams S C, Ignatovitch O, Corbett S J, Winter G. V-BASE Sequence Directory. Cambridge United Kingdom: MRC Centre for Protein Engineering (1997)). In yet another embodiment, the binding molecules according to the invention comprise a heavy chain comprising the variable heavy chain of the amino acid sequence selected from the group consisting of SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:317, SEQ ID NO:321, SEQ ID NO:325, SEQ ID NO:329, SEQ ID NO:333, SEQ ID NO:337, SEQ ID NO:341, SEQ ID NO:345, SEQ ID NO:349, SEQ ID NO:353, SEQ ID NO:357, SEQ ID NO:361, and SEQ ID NO:365. In a further embodiment, the binding molecules according to the invention comprise a light chain comprising the variable light chain of the amino acid sequence selected from the group consisting of SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:319, SEQ ID NO:323, SEQ ID NO:327, SEQ ID NO:331, SEQ ID NO:335, SEQ ID NO:339, SEQ ID NO:343, SEQ ID NO:347, SEQ ID NO:351, SEQ ID NO:355, SEQ ID NO:359, SEQ ID NO:363, and SEQ ID NO:367. Table 8 specifies the heavy and light chain variable regions of the binding molecule of the invention.

Another aspect of the invention includes functional variants of the binding molecules as defined herein. Molecules are considered to be functional variants of a binding molecule according to the invention, if the variants are capable of competing for specifically binding to influenza virus H5N1 or a fragment thereof with the parental binding molecules. In other words, when the functional variants are still capable of binding to influenza virus H5N1 or a fragment thereof. Preferably, the functional variants are capable of competing for specifically binding to at least two (or more) different influenza virus H5N1 strains or fragments thereof that are specifically bound by the parental binding molecules. Furthermore, molecules are considered to be functional variants of a binding molecule according to the invention, if they have neutralizing activity against influenza virus H5N1, preferably against the at least two (or more) influenza virus H5N1 strains against which the parental binding molecule exhibits neutralizing activity. Functional variants include, but are not limited to, derivatives that are substantially similar in primary structural sequence, but which contain e.g. in vitro or in vivo modifications, chemical and/or biochemical, that are not found in the parental binding molecule. Such modifications include inter alia acetylation, acylation, covalent attachment of a nucleotide or nucleotide derivative, covalent attachment of a lipid or lipid derivative, cross-linking, disulfide bond formation, glycosylation, hydroxylation, methylation, oxidation, pegylation, proteolytic processing, phosphorylation, and the like.

Alternatively, functional variants can be binding molecules as defined in the present invention comprising an amino acid sequence containing substitutions, insertions, deletions or combinations thereof of one or more amino acids compared to the amino acid sequences of the parental binding molecules. Furthermore, functional variants can comprise truncations of the amino acid sequence at either or both the amino or carboxyl termini. Functional variants according to the invention may have the same or different, either higher or lower, binding affinities compared to the parental binding molecule but are still capable of binding to influenza virus H5N1 or a fragment thereof. For instance, functional variants according to the invention may have increased or decreased binding affinities for influenza virus H5N1 fragment thereof compared to the parental binding molecules. Preferably, the amino acid sequences of the variable regions, including, but not limited to, framework regions, hypervariable regions, in particular the CDR3 regions, are modified. Generally, the light chain and the heavy chain variable regions comprise three hypervariable regions, comprising three CDRs, and more conserved regions, the so-called framework regions (FRs). The hypervariable regions comprise amino acid residues from CDRs and amino acid residues from hypervariable loops. Functional variants intended to fall within the scope of the present invention have at least about 50% to about 99%, preferably at least about 60% to about 99%, more preferably at least about 70% to about 99%, even more preferably at least about 80% to about 99%, most preferably at least about 90% to about 99%, in particular at least about 95% to about 99%, and in particular at least about 97% to about 99% amino acid sequence homology with the parental binding molecules as defined herein. Computer algorithms such as inter alia Gap or Bestfit known to a person skilled in the art can be used to optimally align amino acid sequences to be compared and to define similar or identical amino acid residues. Functional variants can be obtained by altering the parental binding molecules or parts thereof by general molecular biology methods known in the art including, but not limited to, error-prone PCR, oligonucleotide-directed mutagenesis, site-directed mutagenesis and heavy and/or light chain shuffling. In an embodiment the functional variants of the invention have neutralizing activity against influenza virus H5N1. The neutralizing activity may either be identical, or be higher or lower compared to the parental binding molecules. Henceforth, when the term (human) binding molecule is used, this also encompasses functional variants of the (human) binding molecule.

In yet a further aspect, the invention includes immunoconjugates, i.e. molecules comprising at least one binding molecule as defined herein and further comprising at least one tag, such as inter alia a detectable moiety/agent. Also contemplated in the present invention are mixtures of immunoconjugates according to the invention or mixtures of at least one immunoconjugates according to the invention and another molecule, such as a therapeutic agent or another binding molecule or immunoconjugate. In a further embodiment, the immunoconjugates of the invention may comprise more than one tag. These tags can be the same or distinct from each other and can be joined/conjugated non-covalently to the binding molecules. The tag(s) can also be joined/conjugated directly to the human binding molecules through covalent bonding. Alternatively, the tag(s) can be joined/conjugated to the binding molecules by means of one or more linking compounds. Techniques for conjugating tags to binding molecules are well known to the skilled artisan.

The tags of the immunoconjugates of the present invention may be therapeutic agents, but they can also be detectable moieties/agents. Tags suitable in therapy and/or prevention may be toxins or functional parts thereof, antibiotics, enzymes, other binding molecules that enhance phagocytosis or immune stimulation. Immunoconjugates comprising a detectable agent can be used diagnostically to, for example, assess if a subject has been infected with an influenza virus H5N1 strain or monitor the development or progression of an influenza virus H5N1 infection as part of a clinical testing procedure to, e.g., determine the efficacy of a given treatment regimen. However, they may also be used for other detection and/or analytical and/or diagnostic purposes. Detectable moieties/agents include, but are not limited to, enzymes, prosthetic groups, fluorescent materials, luminescent materials, bioluminescent materials, radioactive materials, positron emitting metals, and non-radioactive paramagnetic metal ions. The tags used to label the binding molecules for detection and/or analytical and/or diagnostic purposes depend on the specific detection/analysis/diagnosis techniques and/or methods used such as inter alia immunohistochemical staining of (tissue) samples, flow cytometric detection, scanning laser cytometric detection, fluorescent immunoassays, enzyme-linked immunosorbent assays (ELISAs), radioimmunoassays (RIAs), bioassays (e.g., phagocytosis assays), Western blotting applications, etc. Suitable labels for the detection/analysis/diagnosis techniques and/or methods known in the art are well within the reach of the skilled artisan.

Furthermore, the human binding molecules or immunoconjugates of the invention can also be attached to solid supports, which are particularly useful for in vitro immunoassays or purification of influenza virus H5N1 or a fragment thereof. Such solid supports might be porous or nonporous, planar or non-planar. The binding molecules of the present invention can be fused to marker sequences, such as a peptide to facilitate purification. Examples include, but are not limited to, the hexa-histidine tag, the hemagglutinin (HA) tag, the myc tag or the flag tag. Alternatively, an antibody can be conjugated to a second antibody to form an antibody heteroconjugate. In another aspect the binding molecules of the invention may be conjugated/attached to one or more antigens. Preferably, these antigens are antigens which are recognized by the immune system of a subject to which the binding molecule-antigen conjugate is administered. The antigens may be identical, but may also differ from each other. Conjugation methods for attaching the antigens and binding molecules are well known in the art and include, but are not limited to, the use of cross-linking agents. The binding molecules of the invention will bind to influenza virus H5N1 and the antigens attached to the binding molecules will initiate a powerful T-cell attack on the conjugate, which will eventually lead to the destruction of the influenza virus H5N1.

Next to producing immunoconjugates chemically by conjugating, directly or indirectly, via for instance a linker, the immunoconjugates can be produced as fusion proteins comprising the binding molecules of the invention and a suitable tag. Fusion proteins can be produced by methods known in the art such as, e.g., recombinantly by constructing nucleic acid molecules comprising nucleotide sequences encoding the binding molecules in frame with nucleotide sequences encoding the suitable tag(s) and then expressing the nucleic acid molecules.

It is another aspect of the present invention to provide a nucleic acid molecule encoding at least a binding molecule, functional variant or immunoconjugate according to the invention. Such nucleic acid molecules can be used as intermediates for cloning purposes, e.g. in the process of affinity maturation as described above. In a preferred embodiment, the nucleic acid molecules are isolated or purified.

The skilled man will appreciate that functional variants of these nucleic acid molecules are also intended to be a part of the present invention. Functional variants are nucleic acid sequences that can be directly translated, using the standard genetic code, to provide an amino acid sequence identical to that translated from the parental nucleic acid molecules.

Preferably, the nucleic acid molecules encode binding molecules comprising the CDR regions as described above. In a further embodiment the nucleic acid molecules encode binding molecules comprising two, three, four, five or even all six CDR regions of the binding molecules of the invention.

In another embodiment, the nucleic acid molecules encode binding molecules comprising a heavy chain comprising the variable heavy chain sequences as described above.

In another embodiment the nucleic acid molecules encode binding molecules comprising a light chain comprising the variable light chain sequences as described above. The nucleotide sequences of the binding molecules of the invention are given in the Example section (see, e.g., Tables 6 and 8).

It is another aspect of the invention to provide vectors, i.e. nucleic acid constructs, comprising one or more nucleic acid molecules according to the present invention. Vectors can be derived from plasmids such as inter alia F, R1, RP1, Col, pBR322, TOL, Ti, etc; cosmids; phages such as lambda, lambdoid, M13, Mu, P1, P22, Qβ, T-even, T-odd, T2, T4, T7, etc; plant viruses. Vectors can be used for cloning and/or for expression of the binding molecules of the invention and might even be used for gene therapy purposes. Vectors comprising one or more nucleic acid molecules according to the invention operably linked to one or more expression-regulating nucleic acid molecules are also covered by the present invention. The choice of the vector is dependent on the recombinant procedures followed and the host used. Introduction of vectors in host cells can be effected by inter alia calcium phosphate transfection, virus infection, DEAE-dextran mediated transfection, lipofectamin transfection or electroporation. Vectors may be autonomously replicating or may replicate together with the chromosome into which they have been integrated. Preferably, the vectors contain one or more selection markers. The choice of the markers may depend on the host cells of choice, although this is not critical to the invention as is well known to persons skilled in the art. They include, but are not limited to, kanamycin, neomycin, puromycin, hygromycin, zeocin, thymidine kinase gene from Herpes simplex virus (HSV-TK), dihydrofolate reductase gene from mouse (dhfr). Vectors comprising one or more nucleic acid molecules encoding the human binding molecules as described above operably linked to one or more nucleic acid molecules encoding proteins or peptides that can be used to isolate the human binding molecules are also covered by the invention. These proteins or peptides include, but are not limited to, glutathione-S-transferase, maltose binding protein, metal-binding polyhistidine, green fluorescent protein, luciferase and beta-galactosidase.

Hosts containing one or more copies of the vectors mentioned above are an additional subject of the present invention. Preferably, the hosts are host cells. Host cells include, but are not limited to, cells of mammalian, plant, insect, fungal or bacterial origin. Bacterial cells include, but are not limited to, cells from Gram-positive bacteria or Gram-negative bacteria such as several species of the genera *Escherichia*, such as *E. coli*, and *Pseudomonas*. In the group of fungal cells preferably yeast cells are used. Expression in yeast can be achieved by using yeast strains such as inter alia *Pichia pastoris, Saccharomyces cerevisiae* and *Hansenula polymorpha*. Furthermore, insect cells such as cells from *Drosophila* and Sf9 can be used as host cells. Besides that, the host cells can be plant cells such as inter alia cells from crop plants such as forestry plants, or cells from plants providing food and raw materials such as cereal plants, or medicinal plants, or cells from ornamentals, or cells from flower bulb crops. Transformed (transgenic) plants or plant cells are produced by known methods, for example, *Agrobacterium*-mediated gene transfer, transformation of leaf discs, protoplast transformation by polyethylene glycol-induced DNA transfer, electroporation, sonication, microinjection or bolistic gene transfer. Additionally, a suitable expression system can be a baculovirus system. Expression systems using mammalian cells such as Chinese Hamster Ovary (CHO) cells, COS cells, BHK cells, NSO cells or Bowes melanoma cells are preferred in the present invention. Mammalian cells provide expressed proteins with posttranslational modifications that are most similar to natural molecules of mammalian origin. Since the present invention deals with molecules that may have to be administered to humans, a completely human expression system would be particularly preferred. Therefore, even more preferably, the host cells are human cells. Examples of human cells are inter alia HeLa, 911, AT1080, A549, 293 and HEK293T cells. In preferred embodiments, the human producer cells comprise at least a functional part of a nucleic acid sequence encoding an adenovirus E1 region in expressible format. In even more preferred embodiments, said host cells are derived from a human retina and immortalized with nucleic acids comprising adenoviral E1 sequences, such as 911 cells or the cell line deposited at the European Collection of Cell Cultures (ECACC), CAMR, Salisbury, Wiltshire SP4 OJG, Great Britain on 29 Feb. 1996 under number 96022940 and marketed under the trademark PER.C60 (PER.C6 is a registered trademark of Crucell Holland B.V.). For the purposes of this application "PER.C6 cells" refers to cells deposited under number 96022940 or ancestors, passages up-stream or downstream as well as descendants from ancestors of deposited cells, as well as derivatives of any of the foregoing. Production of recombinant proteins in host cells can be performed according to methods well known in the art. The use of the cells marketed under the trademark PER.C6® as a production platform for proteins of interest has been described in WO 00/63403 the disclosure of which is incorporated herein by reference in its entirety.

A method of producing a binding molecule according to the invention is an additional part of the invention. The method comprises the steps of a) culturing a host according to the invention under conditions conducive to the expression of the binding molecule, and b) optionally, recovering the expressed binding molecule. The expressed binding molecules can be recovered from the cell free extract, but preferably they are recovered from the culture medium. The above method of producing can also be used to make functional variants of the binding molecules and/or immunoconjugates of the present invention. Methods to recover proteins, such as binding molecules, from cell free extracts or culture medium are well known to the man skilled in the art. Binding molecules, functional variants and/or immunoconjugates as obtainable by the above-described method are also a part of the present invention.

Alternatively, next to the expression in hosts, such as host cells, the binding molecules and immunoconjugates of the invention can be produced synthetically by conventional peptide synthesizers or in cell-free translation systems using RNA nucleic acid derived from DNA molecules according to the invention. Binding molecules and immunoconjugates as obtainable by the above described synthetic production methods or cell-free translation systems are also a part of the present invention.

In yet another embodiment, binding molecules of the present invention can also be produced in transgenic, non-human, mammals such as inter alia rabbits, goats or cows, and secreted into for instance the milk thereof.

In yet another alternative embodiment, binding molecules according to the present invention, preferably human binding molecules specifically binding to influenza virus H5N1 or a fragment thereof, may be generated by transgenic non-human mammals, such as for instance transgenic mice or rabbits, that express human immunoglobulin genes. Preferably, the transgenic non-human mammals have a genome comprising a human heavy chain transgene and a human light chain transgene encoding all or a portion of the human binding molecules as described above. The transgenic non-human mammals can be immunized with a purified or enriched preparation of influenza virus H5N1 or a fragment thereof. Protocols for immunizing non-human mammals are well established in the art. See Using Antibodies: A Laboratory Manual, Edited by: E. Harlow, D. Lane (1998), Cold Spring Harbor Laboratory, Cold Spring Harbor, N.Y. and Current Protocols in Immunology, Edited by: J. E. Coligan, A. M. Kruisbeek, D. H. Margulies, E. M. Shevach, W. Strober (2001), John Wiley & Sons Inc., New York, the disclosures of which are incorporated herein by reference. Immunization protocols often include multiple immunizations, either with or without adjuvants such as Freund's complete adjuvant and Freund's incomplete adjuvant, but may also include naked DNA immunizations. In another embodiment, the human binding molecules are produced by B-cells, plasma and/or memory cells derived from the transgenic animals. In yet another embodiment, the human binding molecules are produced by hybridomas, which are prepared by fusion of B-cells obtained from the above-described transgenic non-human mammals to immortalized cells. B-cells, plasma cells and hybridomas as obtainable from the above-described transgenic non-human mammals and human binding molecules as obtainable from the above-described transgenic non-human mammals, B-cells, plasma and/or memory cells and hybridomas are also a part of the present invention.

In a further aspect, the invention provides a method of identifying a binding molecule, such as a human binding molecule, e.g. a human monoclonal antibody or fragment thereof, specifically binding to influenza virus H5N1 or nucleic acid molecules encoding such binding molecules and comprises the steps of: (a) contacting a collection of binding molecules on the surface of replicable genetic packages with influenza virus H5N1 or a fragment thereof under conditions conducive to binding, (b) selecting at least once for a replicable genetic package binding to influenza virus H5N1 or a fragment thereof, (c) separating and recovering the replicable genetic package binding to influenza virus H5N1 or a fragment thereof from replicable genetic packages that do not bind to influenza virus H5N1 or a fragment thereof. A replicable genetic package as used herein can be prokaryotic or eukaryotic and includes cells, spores, yeasts, bacteria, viruses, (bacterio)phage, ribosomes and polysomes. A preferred replicable genetic package is a phage. The binding molecules, such as for instance single chain Fvs, are displayed on the replicable genetic package, i.e. they are attached to a group or molecule located at an exterior surface of the replicable genetic package. The replicable genetic package is a screenable unit comprising a binding molecule to be screened linked to a nucleic acid molecule encoding the binding molecule. The nucleic acid molecule should be replicable either in vivo (e.g., as a vector) or in vitro (e.g., by PCR, transcription and translation). In vivo replication can be autonomous (as for a cell), with the assistance of host factors (as for a virus) or with the assistance of both host and helper virus (as for a phagemid). Replicable genetic packages displaying a collection of binding molecules is formed by introducing nucleic acid molecules encoding exogenous binding molecules to be displayed into the genomes of the replicable genetic packages to form fusion proteins with endogenous proteins that are normally expressed from the outer surface of the replicable genetic packages. Expression of the fusion proteins, transport to the outer surface and assembly results in display of exogenous binding molecules from the outer surface of the replicable genetic packages.

The selection step(s) in the method according to the present invention can be performed with influenza H5N1 viruses that are live and still infective or inactivated. Inactivation of influenza virus H5N1 may be performed by viral inactivation methods well known to the skilled artisan such as inter alia treatment with formalin, β-propiolactone (BPL), merthiolate, and/or ultraviolet light. Methods to test, if influenza virus H5N1 is still alive, infective and/or viable or partly or completely inactivated are well known to the person skilled in the art. The influenza virus H5N1 used in the above method may be non-isolated, e.g. present in serum and/or blood of an infected individual. The influenza virus H5N1 used may also be isolated from cell culture in a suitable medium.

In an embodiment the influenza virus H5N1 is in suspension when contacted with the replicable genetic packages. Alternatively, they may also be coupled to a carrier when contact takes place. In an embodiment a first and further selection may take place against an influenza virus H5N1 strain of the same clade. Alternatively, first and further selection rounds may be performed against influenza virus H5N1 strains of different clades (e.g. first selection on clade 1 strains and second selection on clade 2 or 3 strains).

Alternatively, the selection step(s) may be performed in the presence of a fragment of influenza virus H5N1 such as e.g. cell membrane preparations, recombinant H5N1 proteins or polypeptides, fusion proteins comprising H5N1 proteins or polypeptides, cells expressing recombinant H5N1 proteins or polypeptides, and the like. Extracellularly exposed parts of these proteins or polypeptides can also be used as selection material. The fragments of influenza virus H5N1 may be immobilized to a suitable material before use or may be used in suspension. In an embodiment the selection can be performed on different fragments of influenza virus H5N1 or fragments of different influenza virus H5N1 strains. Finding suitable selection combinations are well within the reach of the skilled artisan. Selections may be performed by ELISA or FACS.

In yet a further aspect, the invention provides a method of obtaining a binding molecule specifically binding to an influenza virus H5N1 strain or fragment thereof or a nucleic acid molecule encoding such a binding molecule, wherein the method comprises the steps of a) performing the above described method of identifying binding molecules, and b) isolating from the recovered replicable genetic package the binding molecule and/or the nucleic acid molecule encoding the binding molecule. The collection of binding molecules on the surface of replicable genetic packages can be a collection of scFvs or Fabs. Once a new scFv or Fab has been established or identified with the above-mentioned method of identifying binding molecules or nucleic acid molecules encoding the binding molecules, the DNA encoding the scFv or Fab can be isolated from the bacteria or phages and combined with standard molecular biological techniques to make constructs encoding scFvs, bivalent scFvs, Fabs or complete human immunoglobulins of a desired specificity (e.g. IgG, IgA or IgM). These constructs can be transfected into suitable cell lines and complete human monoclonal antibodies can eventually be produced (see Huls et al., 1999; Boel et al., 2000).

As mentioned before the preferred replicable genetic package is a phage. Phage display methods for identifying and obtaining (human) binding molecules, e.g. (human) monoclonal antibodies, are by now well-established methods known by the person skilled in the art. They are, e.g., described in U.S. Pat. No. 5,696,108; Burton and Barbas, 1994; de Kruif et al., 1995b; and Phage Display: A Laboratory Manual. Edited by: C F Barbas, D R Burton, J K Scott and G J Silverman (2001), Cold Spring Harbor Laboratory Press, Cold Spring Harbor, N.Y. All these references are herewith incorporated herein in their entirety. For the construction of phage display libraries, collections of human monoclonal antibody heavy and light chain variable region genes are expressed on the surface of bacteriophage, preferably filamentous bacteriophage, particles, in for example single-chain Fv (scFv) or in Fab format (see de Kruif et al., 1995b). Large libraries of antibody fragment-expressing phages typically contain more than $1.0 \times 10^9$ antibody specificities and may be assembled from the immunoglobulin V-regions expressed in the B-lymphocytes of immunized- or non-immunized individuals. In a specific embodiment of the invention the phage library of binding molecules, preferably scFv phage library, is prepared from RNA isolated from cells obtained from a subject that has been vaccinated against influenza virus (e.g., H5N1), recently vaccinated against an unrelated pathogen, recently suffered from a influenza virus H5N1 infection or from a healthy individual. RNA can be isolated from inter alia bone marrow or peripheral blood, preferably peripheral blood lymphocytes or isolated B-cells or even subpopulations of B-cells such as memory B-cells. The subject can be an animal, preferably a human. In a preferred embodiment the libraries may be assembled from the immunoglobulin V-regions expressed by IgM memory B-cells.

Alternatively, phage display libraries may be constructed from immunoglobulin variable regions that have been partially assembled in vitro to introduce additional antibody diversity in the library (semi-synthetic libraries). For example, in vitro assembled variable regions contain stretches of synthetically produced, randomized or partially randomized DNA in those regions of the molecules that are important for antibody specificity, e.g. CDR regions. Phage antibodies specific for influenza virus H5N1 can be selected from the library by exposing the virus or fragment thereof to a phage library to allow binding of phages expressing antibody fragments specific for the virus or fragment thereof. Non-bound phages are removed by washing and bound phages eluted for infection of E. coli bacteria and subsequent propagation. Multiple rounds of selection and propagation are usually required to sufficiently enrich for phages binding specifically to the virus or fragment thereof. If desired, before exposing the phage library to the virus or fragment thereof the phage library can first be subtracted by exposing the phage library to non-target material such as viruses or fragments thereof of a different strain, i.e. non-H5N1 influenza viruses. These subtractor viruses or fragments thereof can be bound to a solid phase or can be in suspension. Phages may also be selected for binding to complex antigens such as complex mixtures of H5N1 proteins or (poly)peptides optionally supplemented with other material. Host cells expressing one or more proteins or (poly)peptides of influenza virus H5N1 may also be used for selection purposes. A phage display method using these host cells can be extended and improved by subtracting non-relevant binders during screening by addition of an excess of host cells comprising no target molecules or non-target molecules that are similar, but not identical, to the target, and thereby strongly enhance the chance of finding relevant binding molecules. Of course, the subtraction may be performed before, during or after the screening with virus or fragments thereof. The process is referred to as the MABSTRACT® process (MABSTRACT® is a registered trademark of Crucell Holland B.V., see also U.S. Pat. No. 6,265,150 which is incorporated herein by reference).

In yet another aspect the invention provides a method of obtaining a binding molecule potentially having neutralizing activity against influenza virus H5N1, preferably at least against influenza virus H5N1 strains of clade 1, clade 2 and clade 3, wherein the method comprises the steps of (a) performing the method of obtaining a binding molecule specifically binding to influenza virus H5N1 or a fragment thereof or a nucleic acid molecule encoding such a binding molecule as described above, and (b) verifying if the binding molecule isolated has neutralizing activity against the virus, preferably against at least influenza virus H5N1 strains of clade 1 and clade 2. Assays for verifying if a binding molecule has neutralizing activity are well known in the art (see WHO Manual on Animal Influenza Diagnosis and Surveillance, Geneva: World Health Organisation, 2005 version 2002.5).

In a further aspect the invention pertains to a binding molecule having neutralizing activity being obtainable by the methods as described above.

In yet a further aspect, the invention provides compositions comprising at least a binding molecule preferably a human monoclonal antibody according to the invention, at least a functional variant thereof, at least an immunoconjugate according to the invention or a combination thereof. In addition to that, the compositions may comprise inter alia stabilizing molecules, such as albumin or polyethylene glycol, or salts. Preferably, the salts used are salts that retain the desired biological activity of the binding molecules and do not impart any undesired toxicological effects. If necessary, the human binding molecules of the invention may be coated in or on a material to protect them from the action of acids or other natural or non-natural conditions that may inactivate the binding molecules.

In yet a further aspect, the invention provides compositions comprising at least a nucleic acid molecule as defined in the present invention. The compositions may comprise aqueous solutions such as aqueous solutions containing salts (e.g., NaCl or salts as described above), detergents (e.g., SDS) and/or other suitable components.

Furthermore, the present invention pertains to pharmaceutical compositions comprising at least a binding molecule such as a human monoclonal antibody of the invention (or functional fragment or variant thereof), at least an immunoconjugate according to the invention, at least a composition according to the invention, or combinations thereof. The pharmaceutical composition of the invention further comprises at least one pharmaceutically acceptable excipient. Pharmaceutically acceptable excipients are well known to the skilled person. The pharmaceutical composition according to the invention may further comprise at least one other therapeutic agent. Suitable agents are also well known to the skilled artisan.

In an embodiment the pharmaceutical compositions may comprise two or more binding molecules that have neutralizing activity against influenza virus H5N1. In an embodiment, the binding molecules exhibit synergistic neutralizing activity, when used in combination. In other words, the compositions comprise at least two binding molecules having neutralizing activity, characterized in that the binding molecules act synergistically in neutralizing influenza virus H5N1. As used herein, the term "synergistic" means that the combined effect of the binding molecules when used in combination is greater than their additive effects when used individually. The synergistically acting binding molecules may bind to different structures on the same or distinct fragments of influenza virus H5N1. A way of calculating synergy is by means of the combination index. The concept of the combination index (CI) has been described by Chou and Talalay (1984). The compositions may also comprise one binding molecule having neutralizing activity and one non-neutralizing H5N1-specific binding molecule. The non-neutralizing and neutralizing H5N1-specific binding molecules may also act synergistically in neutralizing influenza virus H5N1.

A pharmaceutical composition according to the invention can further comprise at least one other therapeutic, prophylactic and/or diagnostic agent. Preferably, the pharmaceutical composition comprises at least one other prophylactic and/or therapeutic agent. Preferably, said further therapeutic and/or prophylactic agents are agents capable of preventing and/or treating an influenza virus H5N1 infection and/or a condition resulting from such an infection. Therapeutic and/or prophylactic agents include, but are not limited to, anti-viral agents. Such agents can be binding molecules, small molecules, organic or inorganic compounds, enzymes, polynucleotide sequences, anti-viral peptides, etc. Other agents that are currently used to treat patients infected with influenza virus H5N1 are M2 inhibitors (e.g., amantidine, rimantadine) and/or neuraminidase inhibitors (e.g., zanamivir, oseltamivir). These can be used in combination with the binding molecules of the invention. Agents capable of preventing and/or treating an infection with influenza virus H5N1 and/or a condition resulting from such an infection that are in the experimental phase might also be used as other therapeutic and/or prophylactic agents useful in the present invention.

The binding molecules or pharmaceutical compositions of the invention can be tested in suitable animal model systems prior to use in humans. Such animal model systems include, but are not limited to, mouse, ferret and monkey.

Typically, pharmaceutical compositions must be sterile and stable under the conditions of manufacture and storage. The binding molecules, immunoconjugates, nucleic acid molecules or compositions of the present invention can be in powder form for reconstitution in the appropriate pharmaceutically acceptable excipient before or at the time of delivery. In the case of sterile powders for the preparation of sterile injectable solutions, the preferred methods of preparation are vacuum drying and freeze-drying (lyophilization) that yield a powder of the active ingredient plus any additional desired ingredient from a previously sterile-filtered solution thereof.

Alternatively, the binding molecules, immunoconjugates, nucleic acid molecules or compositions of the present invention can be in solution and the appropriate pharmaceutically acceptable excipient can be added and/or mixed before or at the time of delivery to provide a unit dosage injectable form. Preferably, the pharmaceutically acceptable excipient used in the present invention is suitable to high drug concentration, can maintain proper fluidity and, if necessary, can delay absorption.

The choice of the optimal route of administration of the pharmaceutical compositions will be influenced by several factors including the physico-chemical properties of the active molecules within the compositions, the urgency of the clinical situation and the relationship of the plasma concentrations of the active molecules to the desired therapeutic effect. For instance, if necessary, the binding molecules of the invention can be prepared with carriers that will protect them against rapid release, such as a controlled release formulation, including implants, transdermal patches, and microencapsulated delivery systems. Biodegradable, biocompatible polymers can inter alia be used, such as ethylene vinyl acetate, polyanhydrides, polyglycolic acid, collagen, polyorthoesters, and polylactic acid. Furthermore, it may be necessary to coat the binding molecules with, or co-administer the binding molecules with, a material or compound that prevents the inactivation of the human binding molecules. For example, the binding molecules may be administered to a subject in an appropriate carrier, for example, liposomes or a diluent.

The routes of administration can be divided into two main categories, oral and parenteral administration. The preferred administration route is intravenous or by inhalation.

Oral dosage forms can be formulated inter alia as tablets, troches, lozenges, aqueous or oily suspensions, dispersible powders or granules, emulsions, hard capsules, soft gelatin capsules, syrups or elixirs, pills, dragees, liquids, gels, or slurries. These formulations can contain pharmaceutically excipients including, but not limited to, inert diluents, granulating and disintegrating agents, binding agents, lubricating agents, preservatives, colouring, flavouring or sweetening agents, vegetable or mineral oils, wetting agents, and thickening agents.

The pharmaceutical compositions of the present invention can also be formulated for parenteral administration. Formulations for parenteral administration can be inter alia in the form of aqueous or non-aqueous isotonic sterile non-toxic injection or infusion solutions or suspensions. The solutions or suspensions may comprise agents that are non-toxic to recipients at the dosages and concentrations employed such as 1,3-butanediol, Ringer's solution, Hank's solution, isotonic sodium chloride solution, oils, fatty acids, local anaesthetic agents, preservatives, buffers, viscosity or solubility increasing agents, water-soluble antioxidants, oil-soluble antioxidants and metal chelating agents.

In a further aspect, the binding molecules such as human monoclonal antibodies (functional fragments and variants thereof), immunoconjugates, compositions, or pharmaceutical compositions of the invention can be used as a medicament. So, a method of treatment and/or prevention of an influenza virus H5N1 infection using the binding molecules, immunoconjugates, compositions, or pharmaceutical compositions of the invention is another part of the present invention. The above-mentioned molecules can inter alia be used in the diagnosis, prophylaxis, treatment, or combination thereof, of an influenza virus H5N1 infection. They are suitable for treatment of yet untreated patients suffering from an influenza virus H5N1 infection and patients who have been or are treated for an influenza virus H5N1 infection. They may be used for patients such as healthcare workers, relatives of infected subjects, (poultry-)farmers, etc.

The above-mentioned molecules or compositions may be employed in conjunction with other molecules useful in diagnosis, prophylaxis and/or treatment. They can be used in vitro, ex vivo or in vivo. For instance, the binding molecules such as human monoclonal antibodies (or functional variants thereof), immunoconjugates, compositions or pharmaceutical compositions of the invention can be co-administered with a vaccine against influenza virus H5N1 (if available). Alternatively, the vaccine may also be administered before or after administration of the molecules of the invention. Instead of a vaccine, anti-viral agents can also be employed in conjunction with the binding molecules of the present invention. Suitable anti-viral agents are mentioned above.

The molecules are typically formulated in the compositions and pharmaceutical compositions of the invention in a therapeutically or diagnostically effective amount. Alternatively, they may be formulated and administered separately. For instance the other molecules such as the anti-viral agents may be applied systemically, while the binding molecules of the invention may be applied intravenously.

Dosage regimens can be adjusted to provide the optimum desired response (e.g., a therapeutic response). A suitable dosage range may for instance be 0.1-100 mg/kg body weight, preferably 0.5-15 mg/kg body weight. Furthermore, for example, a single bolus may be administered, several divided doses may be administered over time or the dose may be proportionally reduced or increased as indicated by the exigencies of the therapeutic situation. The molecules and compositions according to the present invention are preferably sterile. Methods to render these molecules and compositions sterile are well known in the art. The other molecules useful in diagnosis, prophylaxis and/or treatment can be administered in a similar dosage regimen as proposed for the binding molecules of the invention. If the other molecules are administered separately, they may be administered to a patient prior to (e.g., 2 min, 5 min, 10 min, 15 min, 30 min, 45 min, 60 min, 2 hrs, 4 hrs, 6 hrs, 8 hrs, 10 hrs, 12 hrs, 14 hrs, 16 hrs, 18 hrs, 20 hrs, 22 hrs, 24 hrs, 2 days, 3 days, 4 days, 5 days, 7 days, 2 weeks, 4 weeks or 6 weeks before), concomitantly with, or subsequent to (e.g., 2 min, 5 min, 10 min, 15 min, 30 min, 45 min, 60 min, 2 hrs, 4 hrs, 6 hrs, 8 hrs, 10 hrs, 12 hrs, 14 hrs, 16 hrs, 18 hrs, 20 hrs, 22 hrs, 24 hrs, 2 days, 3 days, 4 days, 5 days, 7 days, 2 weeks, 4 weeks or 6 weeks after) the administration of one or more of the human binding molecules or pharmaceutical compositions of the invention. The exact dosing regimen is usually sorted out during clinical trials in human patients.

Human binding molecules and pharmaceutical compositions comprising the human binding molecules are particularly useful, and often preferred, when to be administered to human beings as in vivo therapeutic agents, since recipient immune response to the administered antibody will often be substantially less than that occasioned by administration of a monoclonal murine, chimeric or humanized binding molecule.

In another aspect, the invention concerns the use of the binding molecules such as neutralizing human monoclonal antibodies (functional fragments and variants thereof), immunoconjugates, nucleic acid molecules, compositions or pharmaceutical compositions according to the invention in the preparation of a medicament for the diagnosis, prophylaxis, treatment, or combination thereof, of an influenza virus H5N1 infection.

Next to that, kits comprising at least a binding molecule such as a neutralizing human monoclonal antibody (functional fragments and variants thereof), at least an immunoconjugate, at least a nucleic acid molecule, at least a composition, at least a pharmaceutical composition, at least a vector, at least a host according to the invention or a combination thereof are also a part of the present invention. Optionally, the above-described components of the kits of the invention are packed in suitable containers and labelled for diagnosis, prophylaxis and/or treatment of the indicated conditions. The above-mentioned components may be stored in unit or multi-dose containers as an aqueous, preferably sterile, solution or as a lyophilised, preferably sterile, formulation for reconstitution. The containers may be formed from a variety of materials such as glass or plastic and may have a sterile access port (for example, the container may be an intravenous solution bag or a vial having a stopper pierceable by a hypodermic injection needle). The kit may further comprise more containers comprising a pharmaceutically acceptable buffer. It may further include other materials desirable from a commercial and user standpoint, including other buffers, diluents, filters, needles, syringes, culture medium for one or more of the suitable hosts and, possibly, even at least one other therapeutic, prophylactic or diagnostic agent. Associated with the kits can be instructions customarily included in commercial packages of therapeutic, prophylactic or diagnostic products, that contain information about for example the indications, usage, dosage, manufacture, administration, contra-indications and/or warnings concerning the use of such therapeutic, prophylactic or diagnostic products.

The invention further pertains to a method of detecting influenza virus H5N1 in a sample, wherein the method comprises the steps of (a) contacting a sample with a diagnostically effective amount of a binding molecule (functional fragments and variants thereof) or an immunoconjugate according to the invention, and (b) determining whether the binding molecule or immunoconjugate specifically binds to a molecule of the sample. The sample may be a biological sample including, but not limited to blood, serum, stool, sputum, nasophargyal aspirates, bronchial lavages, urine, tissue or other biological material from (potentially) infected subjects, or a non-biological sample such as water, drink, etc. The (potentially) infected subjects may be human subjects, but also animals that are suspected as carriers of influenza virus H5N1 might be tested for the presence of the virus using the human binding molecules or immunoconjugates of the invention. The sample may first be manipulated to make it more suitable for the method of detection. Manipulation means inter alia treating the sample suspected to contain and/or containing the virus in such a way that the virus will disintegrate into antigenic components such as proteins, (poly)peptides or other antigenic fragments. Preferably, the human binding molecules or immunoconjugates of the invention are contacted with the sample under conditions which allow the formation of an immunological complex between the human binding molecules and the virus or antigenic components thereof that may be present in the sample. The formation of an immunological complex, if any, indicating the presence of the virus in the sample, is then detected and measured by suitable means. Such methods include, inter alia, homogeneous and heterogeneous binding immunoassays, such as radio-immunoassays (RIA), ELISA, immunofluorescence, immunohistochemistry, FACS, BIACORE and Western blot analyses.

Preferred assay techniques, especially for large-scale clinical screening of patient sera and blood and blood-derived products are ELISA and Western blot techniques. ELISA tests are particularly preferred. For use as reagents in these assays, the binding molecules or immunoconjugates of the invention are conveniently bonded to the inside surface of microtiter wells. The binding molecules or immunoconjugates of the invention may be directly bonded to the microtiter well. However, maximum binding of the binding molecules or immunoconjugates of the invention to the wells might be accomplished by pre-treating the wells with polylysine prior to the addition of the binding molecules or immunoconjugates of the invention. Furthermore, the binding molecules or immunoconjugates of the invention may be covalently attached by known means to the wells. Generally, the binding molecules or immunoconjugates are used between 0.01 to 100 µg/ml for coating, although higher as well as lower amounts may also be used. Samples are then added to the wells coated with the binding molecules or immunoconjugates of the invention.

Furthermore, binding molecules of the invention can be used to identify specific binding structures of influenza virus H5N1. The binding structures can be epitopes on proteins and/or polypeptides. They can be linear, but also structural and/or conformational. In one embodiment, the binding structures can be analysed by means of PEPSCAN analysis (see inter alia WO 84/03564, WO 93/09872, Slootstra et al., 1996). Alternatively, a random peptide library comprising peptides from a protein of influenza virus H5N1 can be screened for peptides capable of binding to the binding molecules of the invention. The binding structures/peptides/epitopes found can be used as vaccines and for the diagnosis of influenza virus H5N1 infections. In case fragments other than proteins and/or polypeptides are bound by the binding molecules, binding structures can be identified by mass spectrometry, high performance liquid chromatography and nuclear magnetic resonance.

In a further aspect, the invention provides a method of screening a binding molecule (or a functional fragment or variant thereof) for specific binding to the same epitope of influenza virus H5N1, as the epitope bound by a human binding molecule of the invention, wherein the method comprises the steps of (a) contacting a binding molecule to be screened, a binding molecule of the invention and influenza virus H5N1 or a fragment thereof, (b) measure if the binding molecule to be screened is capable of competing for specifically binding to influenza virus H5N1 or a fragment thereof with the binding molecule of the invention. In a further step it may be determined, if the screened binding molecules that are capable of competing for specifically binding to influenza virus H5N1 or a fragment thereof have neutralizing activity. A binding molecule that is capable of competing for specifically binding to influenza virus H5N1 or a fragment thereof with the binding molecule of the invention is another part of the present invention. In the above-described screening method, "specifically binding to the same epitope" also contemplates specific binding to substantially or essentially the same epitope as the epitope bound by the a binding molecule of the invention. The capacity to block, or compete with, the binding of the binding molecules of the invention to influenza virus H5N1 typically indicates that a binding molecule to be screened binds to an epitope or binding site on influenza virus H5N1 that structurally overlaps with the binding site on influenza virus H5N1 that is immunospecifically recognized by the binding molecules of the invention. Alternatively, this can indicate that a binding molecule to be screened binds to an epitope or binding site which is sufficiently proximal to the binding site immunospecifically recognized by the binding molecules of the invention to sterically or otherwise inhibit binding of the binding molecules of the invention to influenza virus H5N1.

In general, competitive inhibition is measured by means of an assay, wherein an antigen composition, i.e. a composition comprising influenza virus H5N1 or fragments thereof, is admixed with reference binding molecules, i.e. the binding molecules of the invention, and binding molecules to be screened. Usually, the binding molecules to be screened are present in excess. Protocols based upon ELISAs and Western blotting are suitable for use in such simple competition studies. By using species or isotype secondary antibodies one will be able to detect only the bound reference binding molecules, the binding of which will be reduced by the presence of a binding molecule to be screened that recognizes substantially the same epitope. In conducting a binding molecule competition study between a reference binding molecule and any binding molecule to be screened (irrespective of species or isotype), one may first label the reference binding molecule with a detectable label, such as, e.g., biotin, an enzymatic, a radioactive or other label to enable subsequent identification. Binding molecules identified by these competition assays ("competitive binding molecules" or "cross-reactive binding molecules") include, but are not limited to, antibodies, antibody fragments and other binding agents that bind to an epitope or binding site bound by the reference binding molecule, i.e. a binding molecule of the invention, as well as antibodies, antibody fragments and other binding agents that bind to an epitope or binding site sufficiently proximal to an epitope bound by the reference binding molecule for competitive binding between the binding molecules to be screened and the reference binding molecule to occur. Preferably, competitive binding molecules of the invention will, when present in excess, inhibit specific binding of a reference binding molecule to a selected target species by at least 10%, preferably by at least 25%, more preferably by at least 50%, and most preferably by at least 75%-90% or even greater. The identification of one or more competitive binding molecules that bind to about, substantially, essentially or at the same epitope as the binding molecules of the invention is a straightforward technical matter. As the identification of competitive binding molecules is determined in comparison to a reference binding molecule, i.e. a binding molecule of the invention, it will be understood that actually determining the epitope to which the reference binding molecule and the competitive binding molecule bind is not in any way required in order to identify a competitive binding molecule that binds to the same or substantially the same epitope as the reference binding molecule.

EXAMPLES

To illustrate the invention, the following examples are provided. The examples are not intended to limit the scope of the invention in any way.

Example 1

Construction of scFv Phage Display Libraries Using RNA Extracted from Memory B Cells Peripheral blood was collected from normal healthy donors by venapuncture in EDTA anti-coagulation sample tubes. A blood sample (45 ml) was diluted twice with PBS and 30 ml aliquots were underlayed with 10 ml Ficoll-Hypaque (Pharmacia) and centrifuged at 900×g for 20 min at room temperature without breaks. The supernatant was removed carefully to just above the white layer containing the lymphocytic and thrombocytic fraction. Next, this layer was carefully removed (~10 ml), transferred to a fresh 50 ml tube and washed three times with 40 ml PBS and spun at 400×g for 10 min at room temperature to remove thrombocytes. The obtained pellet containing lymphocytes was resuspended in RPMI medium containing 2% FBS and the cell number was determined by cell counting. Approximately $1\times10^8$ lymphocytes were stained for fluorescent cell sorting using CD24, CD27 and surface IgM as markers for the isolation of IgM memory B cells. A Becton Dickinson Digital Vantage apparatus set in Yield Mode was used for physical memory B cell sorting and isolation. Lymphocytes were gated as the small compact population from the FSC/SSC window. Memory B cells (CD24+/CD27+) were subsequently separated from naive B cells (CD24+/CD27−) and memory T cells (CD24−/CD27+). In a next step, IgM memory B cells (IgM+) were separated from switch memory B cells (IgM-) using IgM expression. In this step IgM memory B cells were sorted in a separate sample tube. $1\times10^5$ cells were collected in DMEM/50% FBS and after completion of the sort they were centrifuged at 400×g for 10 min and lysed in 500 μl TRIZOL total RNA extraction solution (Invitrogen). The RNA was extracted from the lysis solution using 200 μl chloroform and isopropanol precipitation as detailed in the TRIZOL solution protocol. Next, 1 μl Pellet Paint (Novogen) was applied to enhance and visualize the pelleting process. The complete RNA preparation was dissolved in 23 μl DEPC treated ultrapure water (Invitrogen) and used for cDNA conversion with SuperScript III Reverse Transcriptase (Invitrogen). 1 μl Random Hexamers (500 ng/μl) (Promega) was added to the RNA sample and mixed and melted at 65° C. for 5 min in a heated lid PCR machine. The sample was snap-cooled on wet-ice and the following components were added: 8 μl 5×RT buffer (250 mM Tris-HCl pH 8.3, 375 mM KCl, 15 mM $MgCl_2$), 2 μl dNTPs (10 mM of each) (Invitrogen), 2 μl DTT (100 mM), 2 μl RNAse Inhibitor (40 U/μl) (Promega), 2 μl SuperScript III (200 U/μl) (Invitrogen). The obtained mixture was first incubated for 5 min at room temperature and then transferred to a heated lid PCR machine at 50° C. for one hr. The reaction was stopped by heating up to 75° C. for 15 min. The cDNA obtained was diluted to 200 W with ultrapure water and stored at −20° C. until further use.

A two round PCR amplification approach was applied using the primer sets shown in Tables 1 and 2 to isolate the immunoglobulin VH and VL regions from the respective donor repertoire. The PCR formulation for amplification used throughout the procedure was as follows: 5 μl cDNA template, 32.75 μl ultrapure water, 2.5 μl of each primer (10 μM), 5 μl 10×PCR buffer (200 mM Tris-HCl pH 8.4, 500 mM KCl), 1.5 μl $MgCl_2$ (50 mM), 0.5 μl dNTP's (25 mM of each), 0.25 μl Taq polymerase (5 U/μl) (Invitrogen). First round amplification on the respective cDNA using the primer sets mentioned in Table 1 yielded 7, 6 and 9 products of about 650 base pairs for respectively VH, Vkappa and Vlambda regions. For IgM memory B cell VH region amplification the OCM constant primer was used in combination with OH1 to OH7. The thermal cycling program for first round amplifications was: 2 min 96° C. (denaturation step), 30 cycles of 30 sec 96° C./30 sec 55° C./60 sec 72° C., final elongation and 4° C. refrigeration. The products were loaded on and isolated from a 1% agarose gel using gel-extraction columns (Qiagen) and eluted in 50 µl 1 mM Tris-HCl pH 8.0. Ten percent of first round products (5 µl) was subjected to second round amplification using the primers mentioned in Table 2. These primers were extended with restriction sites enabling the directional cloning of the respective VL and VH regions into phage display vector PDV-CO$_6$. The PCR program for second round amplifications was as follows: 2 min 96° C. (denaturation step), 30 cycles of 30 sec 96° C./30 sec 60° C./60 sec 72° C., 10 min 72° C. final elongation and 4° C. refrigeration. The second round products (~350 base pairs) were first pooled according to natural occurrence of J segments found in immunoglobulin gene products, resulting in 7, 6 and 9 pools for respectively the VH, Vkappa and Vlambda variable regions (see Tables 3 and 4). To obtain a normalized distribution of immunoglobulin sequences in the immune library the 6 Vkappa and 9 Vlambda light chain pools were mixed according to the percentages mentioned in Table 3. This single final VL pool (3 µg) was digested overnight with SalI and NotI restriction enzymes, loaded on and isolated from a 1.5% agarose gel (~350 base pairs) using Qiagen gel-extraction columns and ligated in SalI-NotI cut PDV-C06 vector (~5000 base pairs) as follows: 10 µl PDV-CO$_6$ vector (50 ng/µl), 7 µl VL insert (10 ng/µl), 5 µl 10× ligation buffer (NEB), 2.5 T4 DNA Ligase (400 U/µl) (NEB), 25.5 µl ultrapure water (vector to insert ratio was 1:2). Ligation was performed overnight in a water bath of 16° C. Next, the volume was doubled with water, extracted with an equal volume of phenol-chloroform-isoamylalcohol (75:24:1) (Invitrogen) followed by chloroform (Merck) extraction and precipitated with 1 µl Pellet Paint (Novogen), 10 µl sodium acetate (3 M pH 5.0) and 100 µl isopropanol for 2 hrs at −20° C. The obtained sample was subsequently centrifuged at 20.000×g for 30 min at 4° C. The obtained precipitate was washed with 70% ethanol and centrifuged for 10 min at 20.000×g at room temperature. Ethanol was removed by vacuum aspiration and the pellet was air dried for several min and then dissolved in 50 µl buffer containing 10 mM Tris-HCl, pH 8.0. 1 µl ligation mixture was used for the transformation of 40 µl TG-1 electro-competent cells (Stratagene) in a chilled 0.1 cm electroporation cuvette (Biorad) using a Genepulser II apparatus (Biorad) set at 1.7 kV, 200 Ohm, 25 µF (time constant ~4.5 msec). Directly after pulse, the bacteria were flushed from the cuvette with 1000 µl SOC medium (Invitrogen) containing 5% (w/v) glucose (Sigma) at 37° C. and transferred to a 15 ml round bottom culture tube. Another 500 µl SOC/glucose was used to flush residual bacteria from the cuvette and was added to the culture tube. Bacteria were recovered by culturing for exactly one hr at 37° C. in a shaker incubator at 220 rpm. The transformed bacteria were plated over large 240 mm square petridishes (NUNC) containing 200 ml 2TY agar (16 g/l bacto-tryptone, 10 g/l bacto-yeast extract, 5 g/l NaCl, 15 g/l agar, pH 7.0) supplemented with 50 µg/ml ampicillin and 5% (w/v) glucose (Sigma). A 1 to 1000 dilution was plated for counting purposes on 15 cm petridishes containing the same medium. This transformation procedure was repeated sequentially twenty times and the complete library was plated over a total of thirty large square petridishes and grown overnight in a 37° C. culture stove. Typically, around 1×10$^7$ cfu were obtained using the above protocol. The intermediate VL light chain library was harvested from the plates by mildly scraping the bacteria into 10 ml 2TY medium per plate. The cell mass was determined by OD600 measurement and two times 500 OD of bacteria was used for maxi plasmid DNA preparation using two P500 maxiprep columns (Qiagen) according to manufacturer's instructions.

Analogous to the VL variable regions, the second round VH-JH products were first mixed together to obtain the normal J segment usage distribution (see Table 4), resulting in 7 VH subpools called PH1 to PH7. The pools were mixed to acquire a normalized sequence distribution using the percentages depicted in Table 4, obtaining one VH fraction that was digested with SfiI and XhoI restriction enzymes and ligated in SfiI-XhoI cut PDV-VL intermediate library obtained as described above. The ligation set-up, purification method, subsequent transformation of TG 1 and harvest of bacteria was exactly as described for the VL intermediate library (see above). The final library (approximately 5×10$^6$ cfu) was checked for insert frequency with a colony PCR using a primer set flanking the inserted VH-VL regions. More than 95% of the colonies showed a correct length insert (see Table 5). The colony PCR products were used for subsequent DNA sequence analysis to check sequence variation and to assess the percentage of colonies showing a complete ORF. This was typically above 70% (see Table 5). The frequency of mutations in the V genes was also analysed. Out of 50 sequences, 47 (94%) were not in germline configuration indicative of a maturation process and consistent with the memory phenotype of the B cells used as an RNA source for the library. Finally, the library was rescued and amplified by using CT helper phages (see WO 02/103012) and was used for phage antibody selection by panning methods as described below.

Example 2

Selection of Phages Carrying Single Chain Fv Fragments Against H5N1

Antibody fragments were selected using antibody phage display libraries constructed essentially as described above and general phage display technology and MABSTRACT® technology essentially as described in U.S. Pat. No. 6,265,150 and in WO 98/15833 (both of which are incorporated by reference herein). Furthermore, the methods and helper phages as described in WO 02/103012 (which is incorporated by reference herein) were used in the present invention.

Selection was performed against recombinant hemagglutinin (HA) subtype H5 (A/Vietnam/1203/2004; see SEQ ID NO:110) produced using baculovirus vectors in insect cells (Protein Sciences, CT, USA). The amino acid sequence of HA from isolate A/Vietnam/1194/2004 (H5N1TV) and the consensus amino acid sequence representing HAs from strains isolated in Indonesia and China (H5N1IC) are shown in SEQ ID NO:111 and SEQ ID NO:112, respectively. Selections were also performed against soluble recombinant HA (sHA) from H5N1. The sequence encoding for the extracellular (soluble) part of HA (sHA) from isolate A/Vietnam/1194/2004 (H5N1), representing the HAs identified in influenza strains isolated in Thailand and Vietnam (sHA of H5N1TV, SEQ ID NO:113) in 2004 (clade 1) and a consensus sequence representing soluble parts of HAs of H5N1 strains isolated in Indonesia and China (sHA of H5N1IC, SEQ ID NO:114) in 2003/2004 (clade 2) were cloned in an expression vector containing a myc- and his-tag using standard DNA cloning techniques. HAs of H5N1TV and H5N1IC differ at 9 amino acid positions, all located in the HA1 subunit of the molecules. DNA transfections were performed in PER.C6 cells for transient and/or stable expression using standard techniques. sHA was purified from culture supernatant using metal chelate affinity chromatography using HisTrap™ FF Columns (Amersham Biosciences) according to the manufacturer's instructions.

HA antigens (recombinant HA and sHA of H5N1TV) were diluted in PBS (5.0 µg/ml), added to MaxiSorp™ Nunc-Immuno Tubes (Nunc) and incubated overnight at 4° C. on a rotating wheel. The immunotubes were emptied and washed three times in block buffer (2% non-fat dry milk (ELK) in PBS). Subsequently, the immunotubes were filled completely with block buffer and incubated for 1-2 hrs at room temperature. In addition, immunotubes were coated overnight with anti-myc antibody and incubated with block buffer containing 5 µg/ml myc-tagged sHA of H5N1TV. Aliquots of pooled phage display library (500-1000 µl, $0.5 \times 10^{13}$-$1 \times 10^{13}$ cfu, amplified using CT helper phage (see WO 02/103012)) were blocked in blocking buffer supplemented with 10% non-heat inactivated fetal bovine serum and 2% mouse serum for 1-2 hrs at room temperature. The blocked phage library was added to the immunotubes, incubated for 2 hrs at room temperature, and washed with wash buffer (0.05% (v/v) Tween-20 in PBS) to remove unbound phages. Bound phages were eluted from the respective antigen by incubation with 1 ml of 100 mM triethylamine (TEA) for 10 min at room temperature. Subsequently, the eluted phages were mixed with 0.5 ml of 1 M Tris-HCl pH 7.5 to neutralize the pH. This mixture was used to infect 5 ml of an XL1-Blue E. coli culture that had been grown at 37° C. to an OD 600 nm of approximately 0.3. The phages were allowed to infect the XL 1-Blue bacteria for 30 min at 37° C. Then, the mixture was centrifuged for 10 min at 3000×g at room temperature and the bacterial pellet was resuspended in 0.5 ml 2-trypton yeast extract (2TY) medium. The obtained bacterial suspension was divided over two 2TY agar plates supplemented with tetracycline, ampicillin and glucose. After incubation overnight of the plates at 37° C., the colonies were scraped from the plates and used to prepare an enriched phage library, essentially as described by De Kruif et al. (1995a) and WO 02/103012. Briefly, scraped bacteria were used to inoculate 2TY medium containing ampicillin, tetracycline and glucose and grown at a temperature of 37° C. to an OD 600 nm of ~0.3. CT helper phages were added and allowed to infect the bacteria after which the medium was changed to 2TY containing ampicillin, tetracycline and kanamycin. Incubation was continued overnight at 30° C. The next day, the bacteria were removed from the 2TY medium by centrifugation after which the phages in the medium were precipitated using polyethylene glycol (PEG) 6000/NaCl. Finally, the phages were dissolved in 2 ml of PBS with 1% bovine serum albumin (BSA), filter-sterilized and used for the next round of selection.

Alternatively, phage selections using full-length HA-expressing cell lines were performed. To this end, expression vectors containing the complete coding sequence of full-length HA from isolate A/Vietnam/1194/2004 (H5N1TV) and a consensus sequence representing full-length HAs of H5N1 strains isolated in Indonesia and China (H5N1IC) were used to transfect PER.C6 cells. Flow cytometry analysis using an anti-HA antibody was performed in parallel with each phage selection to assure HA expression by H5N1TV- and H5N1IC-transfected PER.C6 cells (data not shown). $10 \times 10^6$ untransfected PER.C6 cells were resuspended in 0.5 ml pooled phage library and 0.5 ml PER.C6 culture medium supplemented with 4% ELK and incubated for 1 hr in an end-over-end rotor set at 5 rpm at 4° C. After 5 min centrifugation at 300×g at 4° C. of the phage library/untransfected PER.C6 cell mixture, the supernatant containing the phages was subtracted for a second time with $10 \times 10^6$ untransfected PER.C6 cells. The subtracted phage preparation was subsequently mixed with $10 \times 10^6$ HA-expressing PER.C6 cells and incubated for 2 hrs in an end-over-end rotor set at 5 rpm at 4° C. Subsequently, the cells were spun for 2 min at 3000×g and the cell pellet was resuspended in 1 ml PBS/0.05% Tween-20 to wash away unbound phages. The cells were centrifuged for 2 min at 3000×g and the washing was repeated for an additional 5 times. After each wash the cells were transferred to a new tube. Bound phages were eluted from the antigen by incubation with 1 ml of 100 mM TEA for 10 min in an end-over-end rotor set at 5 rpm at room temperature. The cells were spun for 2 min at 3000×g and the eluted phages were transferred to a 50 ml tube containing 0.5 ml 1 M Tris-HCl, pH 7.5. Rescue and propagation of the eluted phages was performed as described above. Two rounds of selections were performed before isolation of individual single-chain phage antibodies. After the second round of selection, individual E. coli colonies were used to prepare monoclonal phage antibodies. Essentially, individual colonies were grown to log-phase in 96 well plate format and infected with VCS-M13 helper phages after which phage antibody production was allowed to proceed overnight. The supernatants containing phage antibodies were used directly in ELISA for binding to HA antigens. Alternatively, phage antibodies were PEG/NaCl-precipitated and filter-sterilized for flow cytometry analysis.

Example 3

Validation of the HA Specific Single-Chain Phage Antibodies

Selected single-chain phage antibodies that were obtained in the screening described above were validated in ELISA for specificity, i.e. binding to HA antigens. For this purpose, baculovirus expressed recombinant HA (Protein Sciences, CT, USA) and purified sHAs of H5N1TV and H5N1IC were coated to Maxisorp™ ELISA plates. Anti-myc mA 9F10 (Roche) was immobilized on Maxisorp™ ELISA plates as negative control antigen. After coating, the plates were washed three times with PBS containing 0.1% v/v Tween-20 and blocked in PBS containing 3% BSA or 2% ELK for 1 hr at room temperature. The selected single-chain phage antibodies were incubated for 1 hr in an equal volume of PBS containing 4% ELK to obtain blocked phage antibodies. The plates were emptied, washed three times with PBS/0.1% Tween-20 and the blocked single-chain phage antibodies were added to the wells. Incubation was allowed to proceed for one hr, the plates were washed with PBS/0.1% Tween-20 and bound phage antibodies were detected (using OD 492 nm measurement) using an anti-M 13 antibody conjugated to peroxidase. As a control, the procedure was performed simultaneously without single-chain phage antibody and with a negative control single-chain phage antibody. From the selections on the different HA antigens with the IgM memory B cell library, 92 unique single-chain phage antibodies specific for either recombinant HA or sHA were obtained.

Alternatively, the reactivity of single chain antibodies that were selected for binding to HA-expressing PER.C6 cells was tested using flow cytometry analysis. PEG/NaCl precipitated phages were mixed with an equal volume of PBS/2% ELK blocked for 30 min on ice. The blocked phages were added to pelleted cells (untransfected PER.C6 and HA-expressing PER.C6 cells) and incubated for one hr on ice. The cells were washed three times with PBS/1% BSA, followed by a 1 minute centrifugation at 300×g, and binding of the single chain phage antibodies to the cells was visualized using a biotinylated anti-M13 antibody (Fitzgerald) followed by streptavidin-phycoerythrin conjugate (Caltag). The selections using HA-expressing PER.C6 cells provided 24 unique single-chain phage antibodies that were not identified during selections using the different recombinant HA proteins.

Example 4

Characterization of the HA Specific scFvs

From the selected specific single-chain phage antibodies (scFv) clones plasmid DNA was obtained and nucleotide and amino acid sequences were determined according to standard techniques. The nucleotide and amino acid sequence and VH and VL gene identity (see Tomlinson I M et al. V-BASE Sequence Directory. Cambridge United Kingdom: MRC Centre for Protein Engineering (1997)) of the scFvs are depicted in Table 6. The CDR regions of the HA-specific immunoglobulins are shown in Table 7.

Example 5

Construction of Fully Human Immunoglobulin Molecules (Human Monoclonal Antibodies) from the Selected Single Chain Fvs Heavy and light chain variable regions of the scFvs were cloned directly by restriction digest for expression in the IgG expression vectors pIg-C911-HCgamma1 (see SEQ ID No:141), pIg-C909-Ckappa (see SEQ ID NO:142), or pIg-C910-Clambda (see SEQ ID No:143). Nucleotide sequences for all constructs were verified according to standard techniques known to the skilled artisan. The resulting expression constructs encoding the human IgG1 heavy and light chains were transiently expressed in combination in 293T cells and supernatants containing human IgG1 antibodies were obtained and produced using standard purification procedures. The human IgG1 antibodies were titrated in a concentration range of between 10 and 0.003 µg/ml against H5 (data not shown). A SARS-CoV specific antibody was included as a control antibody. The IgG1 molecules showed the same pattern of reactivity as demonstrated for the single-chain phage antibodies.

The nucleotide and amino acid sequences of the heavy and light chain of the antibodies called CR6141, CR6255, CR6257, CR6260, CR6261, CR6262, CR6268, CR6272, CR6296, CR6301, CR6307, CR6310, CR6314, CR6323, CR6325, CR6327, CR6328, CR6329, CR6331, CR6332, CR6334, CR6336, CR6339, CR6342, CR6343 and CR6344 as well as their heavy and light chain variable regions are given in Table 8. Subsequently, binding of the anti-HA IgG to HA-expressing PER.C6 cells was investigated by flow cytometry. Flow cytometry analysis for antibody binding to HA demonstrated that antibodies CR6255, CR6257, CR6260, CR6261, CR6262, CR6268, CR6307, CR6310, CR6314, CR6323, CR6325, CR6331 and CR6344 bound to HA (H5N1TV)-expressing PER.C6 cells (see Table 9). Antibodies CR6261 and CR6344 also displayed binding to untransfected control cells, but the obtained signals were approximately 10-fold lower than the signals obtained for binding to HA (H5N1TV)-expressing PER.C6 cells (see Table 9). No binding of control antibody CR3014 to HA-expressing cells and untransfected control cells was observed.

Example 6

In Vitro Neutralization of H5N1 Influenza Virus by H5N1 Specific IgGs (Virus Neutralization Assay)

In order to determine whether the selected IgGs were capable of blocking H5N1 infection, in vitro virus neutralization assays (VNA) were performed. The VNA were performed on MDCK cells (ATCC CCL-34). MDCK cells were cultured in MDCK cell culture medium (MEM medium supplemented with antibiotics, 20 mM Hepes and 0.15% (w/v) sodium bicarbonate (complete MEM medium), supplemented with 10% (v/v) fetal bovine serum). The H5N1 reassortant strain NIBRG-14 which was used in the assay was diluted to a titer of $4 \times 10^3$ TCID50/ml (50% tissue culture infective dose per ml), with the titer calculated according to the method of Spearman and Karber. The IgG preparations (200 µg/ml) were serially 2-fold diluted (1:2-1:16) in complete MEM medium in duplicate wells. 25 µl of the respective IgG dilution was mixed with 25 Id of virus suspension (100 TCID50/25 µl) and incubated for one hr at 37° C. The suspension was then transferred in duplicate onto 96-well plates containing confluent MDCK cultures in 50 µl complete MEM medium. Prior to use, MDCK cells were seeded at $3 \times 10^4$ cells per well in MDCK cell culture medium, grown until cells had reached confluence, washed with 300-350 µl PBS, pH 7.4 and finally 50 pd complete MEM medium was added to each well. The inoculated cells were cultured for 3-4 days at 33° C. and observed daily for the development of cytopathic effect (CPE). CPE was compared to the positive control (NIBRG-14-inoculated cells) and negative controls (mock-inoculated cells). The complete absence of CPE in an individual cell culture was defined as protection. Sheep anti-A/Vietnam/1194/04H5N1 influenza virus HA (04/214, N1BSC) was used as a positive control in the assay.

In addition, cultures were tested for the presence of virus using immunohistochemistry. To this end, the culture supernatant was discarded and the cells were fixed with 40% (v/v) acetone and 60% (v/v) methanol for 15 min. Fixed cells were blocked for 30 min at 37° C. in blocking buffer (200 mM NaCl, 0.2% (w/v) bovine serum albumin (BSA), 0.01% thimerosal, 0.2% (v/v) Tween-20, 20 mM Tris-HCl, pH 7.45) supplemented with 2% (w/v) BSA and 5% (v/v) goat serum. Subsequently, cells were incubated for one hr at 37° C. with 50 µl mouse anti-influenza A monoclonal antibody blend (Chemicon) diluted 1:1000 in washing buffer. After three washes with washing buffer, 50 µl of biotin-conjugated goat anti-mouse IgG (Jackson) diluted 1:1000 in washing buffer was added and incubated for one hr at 37° C. After three washes with washing buffer, 50 µl of streptavidin-peroxidase conjugate (Calbiochem) diluted 1:3000 in washing buffer was added and incubated for 30 min at 37° C. After another three washes with washing buffer, staining was visualized using AEC solution (0.12% (w/v) 3-amino-9-ethylcarbazole, 30% (v/v) N—N-dimethylformamide and 70% (v/v) acetate buffer) containing 1 µl $H_2O_2$/1 ml AEC solution. After three washes with washing buffer, staining was analysed under a microscope.

The human anti-HA antibodies called CR6255, CR6257, CR6260, CR6261, CR6262, CR6268, CR6307, CR6310, CR6314, CR6323, CR6325, CR6331 and CR6344 were subjected to the above-described VNA. All antibodies neutralized H5N1 reassortant strain NIBRG-14. The concentrations (in µg/ml) at which these antibodies protect MDCK cultures against CPE are given in Table 10. In wells where CPE was observed, the presence of virus was confirmed by immuno-histochemical staining (data not shown).

In order to determine the neutralizing potency of the H5N1 specific IgGs more accurately, the in vitro virus neutralization assays with NIBRG-14 was repeated, but this time the IgG preparations were further diluted. The IgG preparations (200 µg/ml) were serially 2-fold diluted (1:1-1:512) in complete MEM medium and tested in quadruplicate wells in the VNA as described above. The neutralizing potency of the human anti-H5N1 antibodies called CR6255, CR6257, CR6260, CR6261, CR6262, CR6268, CR6272, CR6307, CR6310, CR6314, CR6323, CR6325, CR6327, CR6328, CR6329, CR6331, CR6332, CR6334, CR6336, CR6339, CR6342, CR6343 and CR6344 was determined in the VNA. All antibodies, except CR6272 and CR6339, neutralized H5N1 reassortant strain NIBRG-14. The concentrations (in µg/ml, in the presence of 100 TCID50 of virus) at which these antibodies protect MDCK cultures against CPE are indicated in Table 11. In wells where CPE was observed, the presence of virus was confirmed by immunohistochemical staining (data not shown).

Example 7

Immunoblot Analysis of H5N1 Specific IgGs

Figure 1:
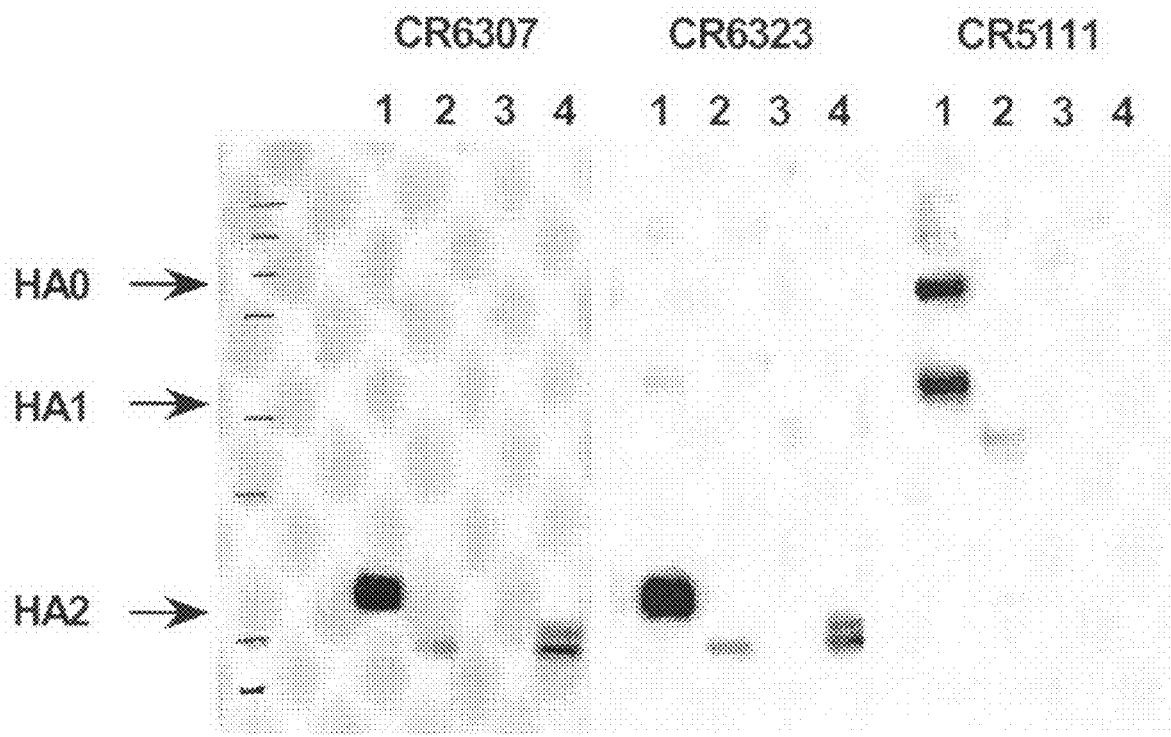
In FIG. 1 immunoblot analysis of different hemagglutinins (HAs) using antibodies CR6307 (left part), CR6323 (middle part) and CR5111 (right part) is presented. Recombinant HAs were subjected to reducing SDS-PAGE analysis and immunoblot analysis. In lanes 1 sHA of H5N1TV is shown; in lanes 2 recombinant HA, subtype H5 (A/Vietnam/1203/2004 (H5N1)) is shown; in lanes 3 recombinant HA, subtype H3 (A/Wyoming/3/2003(H3N2)) is shown; and in lanes 4 recombinant HA, subtype H1 (A/New Caledonia/20/99 (H1N1)) is shown. The position where HA0, HA1 and HA2 can be found is also indicated.

To further investigate the specificity of the anti-HA antibodies, different recombinant hemagglutinin Influenza A antigens were subjected to SDS-PAGE under reducing conditions followed by anti-HA immunoblot analysis. The HA0 polypeptide is composed of the HA1 and HA2 subunit. Antibody CR5111, a H5N1-specific control antibody, recognized the HA1 subunit and the intact (uncleaved) HA0 polypeptide of sHA of H5N1TV (see FIG. 1, right part, lane 1). In addition, CR5111 recognized the HA1 subunit of recombinant HA, subtype H5 (A/Vietnam/1203/2004 (H5N1); see SEQ ID NO:110) produced using baculovirus vectors in insect cells (Protein Sciences, CT, USA) (FIG. 1, right part, lane 2). Uncleaved HA0 polypeptide was not detected in this HA preparation. The difference in size between the HA subunits in lanes 1 and 2 might be explained by a different glycosylation of HA expressed in insect cells and PER.C6 cells. CR5111 did not recognize the HA1 and/or HA0 polypeptides of recombinant HA, subtype H1 (A/New Caledonia/20/99 (H1N1)) (see FIG. 1, right part, lane 4) or of recombinant HA, subtype H3 (A/Wyoming/3/2003(H3N2)) (FIG. 1, right part, lane 3).

Antibodies CR6307 and CR6323 recognized the HA2 subunits of sHA of H5N1TV (see FIG. 1, left and middle part, lanes 1) and recombinant HA, subtype H5 (A/Vietnam/1203/2004 (H5N1)) (see FIG. 1, left and middle part, lanes 2). Interestingly, the HA2 subunit as present in the intact, uncleaved HA0 polypeptides was not recognized. Apparently, the epitope recognized by CR6307 and CR6323 becomes accessible upon cleavage of HA0. In addition, antibodies CR6307 and CR6323 recognized the HA2 subunit of recombinant HA, subtype H1 (A/New Caledonia/20/99 (H1N1)) (see FIG. 1, left and middle part, lanes 4), but not the HA2 subunit of recombinant HA, subtype H3 (A/Wyoming/3/2003(H3N2)) (see FIG. 1, left and middle part, lanes 3), both recombinant HAs produced using baculovirus vectors in insect cells (Protein Sciences, CT, USA). Because the binding site of neutralizing antibodies CR6307 and CR6323 is conserved within influenza A strains of the subtype H1 and H5, a molecule comprising the binding site could be considered as (part of a) vaccine capable of inducing a broadly cross-reactive anti-influenza antibody response.

Next to antibodies CR6307 and CR6323, the antibodies called CR6141, CR6296, and CR6301 were used in immunoblot analysis. Each of the three antibodies was able to bind to the HA2 subunit of sHA of H5N1TV and recombinant HA, subtype H5 (A/Vietnam/1203/2004; H5N1) (data not shown).

Example 8

FACS Analysis to Determine the Subunit Specificity of H5N1 Specific IgGs

In order to evaluate the contribution of the HA1 subunit to binding of anti-H5N1 antibodies, an assay was set up, wherein the HA1 subunit is released from HA-expressing PER.C6 cells. HA-expressing PER.C6 cells were washed three times with PBS, pH 7.4, and incubated for 10 min in acidified PBS, pH 4.9. Subsequently, the cells were washed with PBS, pH 7.4, and treated for 10 min with 10 µg/ml trypsin in PBS, pH 7.4, to cleave HA0 molecules into disulfide bond-linked HA1 and HA2 subunits. Finally, the cells were incubated for 20 min in 20 mM DTT in PBS, pH 7.4, to release the HA1 subunit from the membrane-anchored HA2 subunit. Untreated and acid/trypsin/DTT-treated cells were washed twice with PBS containing 1% w/v BSA. For flow cytometry analysis, $2.5 \times 10^5$ cells were used per staining. No staining of treated and untreated cells with the negative control antibody CR3014 was observed. Antibody CR5111, which binds to the HA 1 subunit in immunoblot analysis, stained the population of untreated HA-expressing PER.C6 cells, while treated cells were not recognized (data not shown). This provides further proof that CR5111 recognizes the HA1 subunit. Treated and untreated cells were stained to a similar extent by the antibodies CR6307 and CR6323 (data not shown). Release of the HA1 subunit obviously did not influence binding of these antibodies further substantiating the results from the immunoblot analysis that the antibodies bind to the HA2 subunit. Antibodies CR6325 and CR6331 bound to untreated cells, while binding to treated cells was markedly reduced compared with binding to untreated cells (data not shown). This suggests that the affinity of the antibodies for their epitope is significantly reduced by the conformational change induced upon acid treatment or by the reduction of the disulfide bond that links the HA1 and HA2 subunit.

Example 9

Hemagglutinin Competition ELISA with Phage Antibodies and IgGs

To identify antibodies that bind to non-overlapping, non-competing epitopes, a hemagglutinin competition ELISA was performed. Nunc-Immuno™ Maxisorp F96 plates were coated overnight at 4° C. with 0.5 µg/ml recombinant HA, subtype H5 (A/Vietnam/1203/2004 (H5N1) (Protein Sciences) in PBS. Uncoated protein was washed away before the wells were blocked with 300 µl PBS containing 2% w/v non-fat dry milk (blocking solution) for 1 hr at room temperature. The blocking solution was discarded and 50 µl of 10 µg/ml anti-H5N1 IgG in blocking solution was incubated per well for 1 hr at room temperature. Subsequently, 50 µl of phage antibody in blocking solution in a concentration twice of the concentration that resulted in 50% maximal binding (as determined in a previous assay) was added per well and incubated for another hr at room temperature. Wells were washed three times with PBS containing 0.1% v/v Tween-20. Bound phage antibody was detected using a peroxidase-conjugated anti-M13 antibody. Wells were washed again as described above and the ELISA was further developed by the addition of 100 µl of OPD reagent (Sigma). The reaction was stopped by adding 50 µl 1 M $H_2SO_4$ and then the OD at 492 nm was measured. Binding of phage antibody, in the presence of IgG, was expressed as percentage of binding in the absence of IgG, which was set at 100%. Phage antibody SC05-111 and corresponding IgG CR5111, which recognize an epitope in the HA1 subunit of H5 hemagglutinin were included as controls.

The results indicate that the majority of the phage antibodies and IgGs bind to an overlapping epitope on recombinant HA, subtype H5 (A/Vietnam/1203/2004 (H5N1)) (data not shown). Binding of SC05-111 phage antibody was blocked by CR5111 IgG, but not by any other IgG, suggesting that the other IgGs recognize an epitope different from the binding region of CR5111. Five IgGs, CR6262, CR6272, CR6307, CR6339 and CR6343 competed to a lower extent for binding than the rest of the IgGs (more than 25% residual binding). For IgGs CR6262, CR6272, CR6339, and CR6343 this can be explained by a lower affinity for HA. This is supported by the observation that the phage antibodies corresponding to these antibodies were competed away more efficiently by the other IgGs. Binding of phage antibody SC06-307 is blocked by IgG CR6307, but less efficiently by the other IgGs. This suggests that SC06-307 and CR6307 recognize a unique epitope which differs from the epitope recognized by the other IgGs.

Example 10

Cross-Reactivity ELISA Using Anti-H5N1 IgGs

To test whether the epitope of the anti-H5N1 antibodies is conserved among HAs other than subtype H5, a hemagglutinin cross-reactivity ELISA was performed. Nunc-Immuno™ Maxisorp F96 plates (Nunc) were coated overnight at 4° C. with 0.5 µg/ml recombinant HA, subtype H1 (A/New Caledonia/20/99 (H1N1)), subtype H3 (A/Wyoming/3/03 (H3N2)), subtype H5 (A/Vietnam/1203/04 (H5N1)), subtype H7 (A/Netherlands/219/03 (H7N7)), and subtype H9 (A/Hong Kong/1073/99 (H9N2)) (Protein Sciences Corp.) in PBS. Additionally, BPL-inactivated virus preparations containing 0.5 µg/ml of HA of A/New Caledonia/20/99 (H1N1), and reassortant strain NIBRG-14 (A/Vietnam/1194/04 (H5N1)) were coated on the plates overnight in PBS. Wells were washed three times with PBS containing 0.1% v/v Tween-20 to remove uncoated protein and subsequently blocked with 300 µl PBS containing 2% w/v non-fat dry milk (blocking solution) for 1 hr at room temperature. The blocking solution was discarded and 100 µl per well of 5 µg/ml anti-H5N1 antibodies in blocking solution was incubated for 1 hr at room temperature. Wells were washed three times with PBS containing 0.1% v/v Tween-20 and bound antibodies were detected using a peroxidase-conjugated mouse anti-human IgG antibody (Jackson). The reaction was developed and measured as described supra. Table 12 shows that all anti-H5N1 IgGs bound to recombinant HA, subtype H5 (A/Vietnam/1203/2004 (H5N1)) and a BPL-inactivated virus preparation of NIBRG-14, which contains the HA of strain A/Vietnam/1194/2004 (H5N1). Recombinant HAs of subtype H3 and H7 were not recognized by any of the tested anti-H5N1 IgGs. Interestingly, all anti-H5N1 IgGs, with the exception of CR5111 and CR6307, bound to recombinant HA of subtypes H1 and H9, and a BPL-inactivated virus preparation of strain A/New Caledonia/20/99 (H1N1). This indicates that the epitope of the majority of the anti-H5N1 IgGs is conserved among HA molecules of different subtypes.

Example 11

Epitope Lapping of Anti-H5N1 IgGs

Okuno et al. (1993) and Smirnov et al. (1999) demonstrated the existence of a common epitope shared by the HAs of the influenza A virus subtypes H1, H2, and H5 and neutralization of these subtypes by the murine monoclonal antibody C179 directed against this epitope. This conformational epitope is composed of two different sites which are located in the HA1 and HA2 subunit. Both sites are located in close proximity in the middle of the stem region of the HA molecule. In order to evaluate whether the anti-HA antibodies described supra recognized this epitope, HA molecules containing amino acid substitutions in this region were made.

The epitope recognized by antibody C179 (Takara Bio Inc.) has been attributed to regions encompassing residues 318-322 of the HA1 subunit and residues 47-58 of the HA2 subunit (amino acid numbering as described by Okuno et al. 1999). Escape viruses containing HAs that carry a Thr to Lys substitution at position 318 in the HA1 subunit or a Val to Glu substitution at position 52 in the HA2 subunit were no longer recognized and neutralized by C179. These mutations (position 318 Thr to Lys, mutant I; position 52 Val to Glu, mutant II), a Leu to Met substitution at position 320 in the HA1 subunit (mutant III, Met320 is present in region 318-322 of HA1 of subtype H3 and H7), a Ser to Arg substitution at position 54 in the HA2 subunit (mutant IV, Arg54 is present in region 47-58 of HA2 of subtype H3 and H7) and an Asp to Asn substitution at position 57 in the HA2 subunit (mutant V, Asn57 is present in region 47-58 of HA2 of strain A/Hong Kong/156/97 (H5N1)) were introduced in full-length HA from isolate A/Vietnam/1194/2004 (H5N1TV) and transfected in PER.C6 cells. Binding of C179 and the human anti-HA antibodies to PER.C6 cells expressing these mutants was evaluated by FACS analysis as described supra. Antibody CR5111, which is directed against an epitope in the HA1 subunit, and a polyclonal anti-H5 sheep serum confirmed the expression of H5N1TV and HA mutants by transfected PER.C6 cells (data not shown). No staining with the negative control antibody CR3014 or in the absence of antibody was observed (data not shown). As expected, antibody C179 did not recognize mutants I and II, which carried the same amino acid substitutions as the HAs in the C179 escape viruses (see Okuno et al., 1993). Furthermore, C179 did not bind to mutant IV, whereas binding of C179 to mutants III and V was unaffected. A similar pattern of reactivity was observed for antibody CR6342, which suggests that antibody C179 and CR6342 recognize a similar epitope. Antibodies CR6261, CR6325 and CR6329 recognized all mutants, with the exception of mutant II. This suggests that the epitope of antibodies CR6261, CR6325 and CR6329 is different from that of C179. Since substitutions in the HA1 subunit did not abrogate binding of these antibodies, their epitope is most likely located in the HA2 subunit. Antibodies CR6307 and CR6323 recognized all mutants, which suggests that also the epitope of these antibodies is different from that of C179. A summary of the sequence of the mutants and binding of the antibodies is given in Table 13. In conclusion, the results indicate that antibodies CR6261, CR6325, CR6329, CR6307 and CR6323 are ideal candidates to bind to and neutralize influenza viruses that have mutations in the epitope recognized by the murine monoclonal antibody C179 and as a consequence thereof are no longer neutralized by this antibody.

Example 12

Prophylactic Activity of Human IgG Monoclonal Antibodies Against Lethal H5N1 Challenge In Vivo A lethal dose of influenza H5N1 strain A/HongKong/156/97 was administered to mice in order to study the prophylactic effect of human monoclonal IgG antibodies CR6261, CR6323 and CR6325. One day prior to infection 8 groups of 10 mice each were injected intraperitoneally with different doses of antibody. As a negative control one group of mice was injected with a non-relevant control antibody (CR3014). Clinical signs, weight loss and mortality were monitored until 21 days after infection. This study was conducted to assess the prophylactic effect of the monoclonal human anti-H5N1 IgG antibodies in vivo.

The H5N1 strain was originally obtained from a 3-year-old child suffering from respiratory disease. The virus was passaged two times on MDCK cells. The batch [Titre 8.1 log $TCID_{50}$/ml] used to infect mice was propagated once in embryonated eggs.

80 female 7-week-old Balb/c mice were divided in the 8 groups of 10 mice each with the following injections prior to challenge with the H5N1 virus:
1. 15 mg/kg CR6261.
2. 5 mg/kg CR6261.
3. 2 mg/kg CR6261.
4. 0.7 mg/kg CR6261.
5. 15 mg/kg CR6323.
6. 15 mg/kg CR6325
7. 500 µl rabbit anti-H5N3 immune serum (100× diluted).
8. 15 mg/kg CR3014.

All animals were acclimatized and maintained for a period of 6 days prior to the start of the study. One day prior to infection with H5N1 virus, 500 µl of antibody was administered by intraperitoneal injection. The animals were inoculated intranasally on day 0 with 25 $LD_{50}$ Of virus (approximately 50 µl), and followed for 21 days. The actual dose of the virus administered was estimated by titrating a few replicate samples from the inoculum remaining after inoculation of the animals was completed. Virus titers (TCID50/mL) of the inoculum were determined on MDCK cells. The results showed that no inactivation of virus had unintentionally occurred during preparation or administration of the inoculum. Group 8 acted as negative control. The animals in this group were injected with an irrelevant monoclonal antibody (CR3014) on day 0. Group 7 was supposed to act as positive control. The mice in this group were injected with a rabbit polyclonal serum antibody raised against H5N3 influenza virus.

Clinical signs and weights were assessed daily from day −1 until 21 days after virus inoculation. Clinical signs were scored with a scoring system (0=no clinical signs; 1=rough coat; 2=rough coat, less reactive, passive during handling; 3=rough coat, rolled up, laboured breathing, passive during handling; 4=rough coat, rolled up, laboured breathing, does not roll back on stomach when laid down on its back) and recorded. Surviving animals were euthanised and bled on day 21. For analysis of serum IgG antibody levels blood samples were collected from each mouse on day O, Sera were prepared according to standard procedure. To generate post infection sera, blood was collected from surviving animals on day 21. Sera were stored at −20° C.±2° C. until assayed for the presence of virus specific antibodies. Sera were tested in duplicate using 4 HAU of the H5N1 HK/97 substrate. Titers were expressed as the reciprocal of the highest serum dilution showing HI, starting at a dilution of 1/10.

Figure 2:
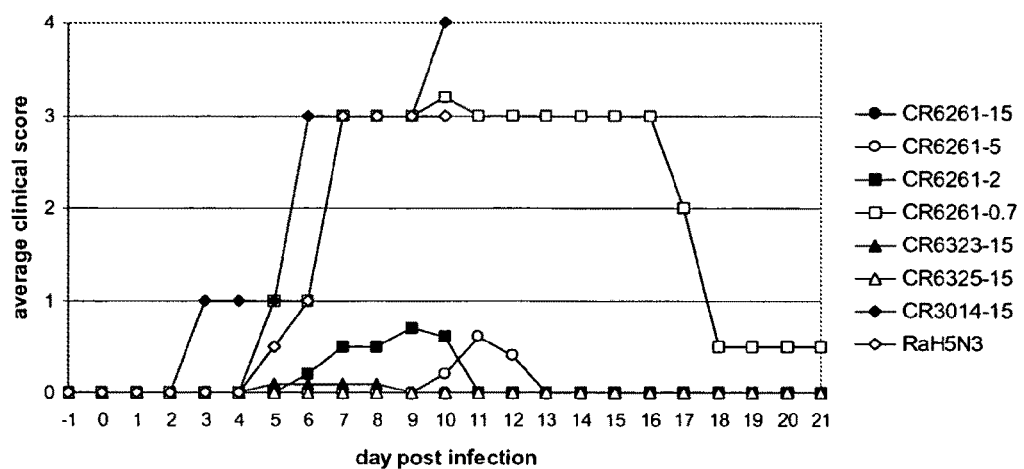
FIG. 2 shows the average clinical score per group of mice in a study (example 12) wherein, one day before infection with influenza H5N1 virus, mice were prophylactically treated with three human H5N1 monoclonal antibodies CR6261, CR6323, and CR6325, in different doses.

All mice were active and appeared healthy without showing signs of disease during the acclimatization period. The average clinical score (total clinical score divided by number of surviving animals in each group) was calculated per day and the results are indicated in FIG. 2 (average clinical score per group), Table 14 (clinical scores) and Table 15 (respiratory distress). Onset of negative clinical signs was observed at day 3 after infection in the group that was inoculated with the negative control Ab CR3014 (group 8). Respiratory distress was first recorded on day 6, and lasted for 1 to 4 days. No clinical signs were observed in mice that were treated with 15 mg/kg of CR6325 (group 6). In group 5 (CR6323), one mouse showed mild clinical signs (score 1) from day 5 to 8 and died the next day. In group 1, one mice died on day 13 without having shown any previous clinical signs. Higher Ab doses of CR6261 correlated with later onset and lower clinical scores on average. Respiratory distress was noticed in the lowest dose group (0.7 mg/kg), but not in the higher dose groups (2, 5 and 15 mg/kg). All mice showed improvement in their clinical condition between day 9 and 13 (group 2, 3 and 5) or from day 17 on (group 4). Mice that were injected with the rabbit polyclonal antibody (group 7) developed severe illness within 3 days and then died, demonstrating that the rabbit antibody did not protect against infection in vivo. Two animals (one in group 4 and one in group 8) were euthanized on day 10 and removed from the study, because the animals were considered to be severely ill (score 4).

Figure 3:
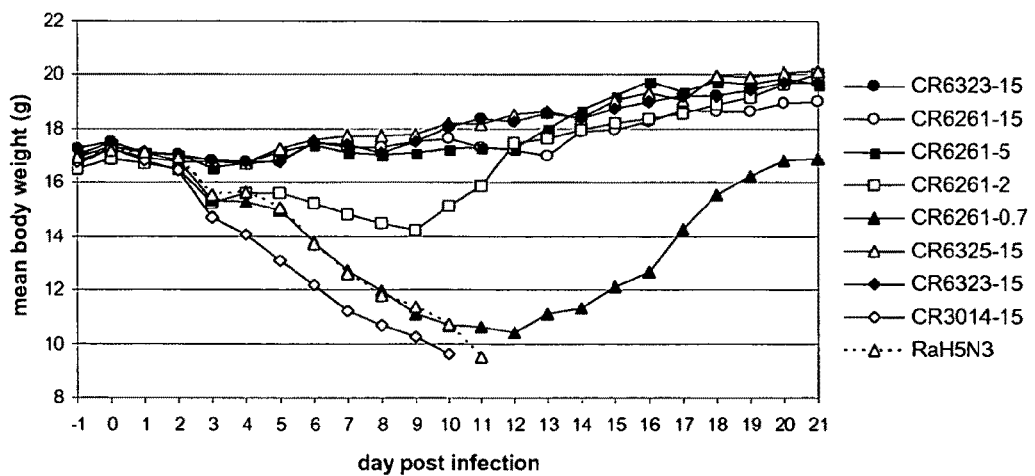
FIG. 3 shows the change in body weight during the prophylactic treatment of mice with anti-H5N1 antibodies during 21 days post-infection (example 12).

The animals infected with H5N1 showed varying degrees of weight loss (FIG. 3). Proportional weight loss and the moment of onset were related to antibody dose. In the groups treated with the highest dose of antibodies weight steadily increased over time consistent with age-related weight gain. The group of animals inoculated with the lowest dose of CR6261 lost weight more quickly than the groups of animals receiving higher doses of antibody. The total amount of weight loss was greater in the lower dose groups, with average weight loss of about 15 and 40% of starting weight in the groups inoculated with 2 and 0.7 mg/kg CR6261, respectively. In the lower dose groups average body weight appeared to increase again at the same time as animals showed some clinical improvement.

Figure 4:
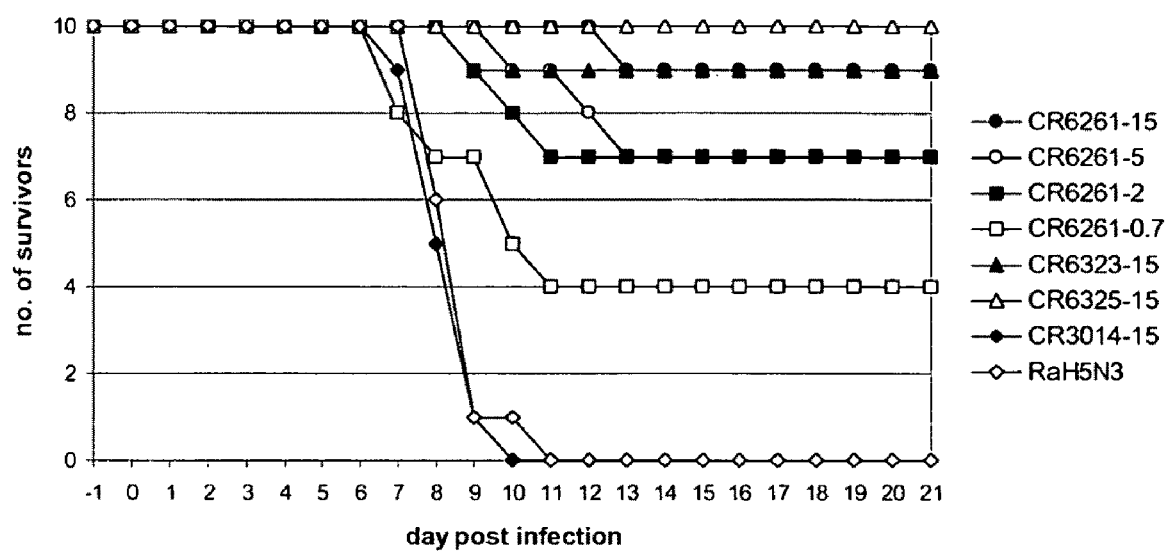
FIG. 4 shows the number of surviving mice in the different groups in the study of FIGS. 2 and 3 (example 12).
Figure 5:
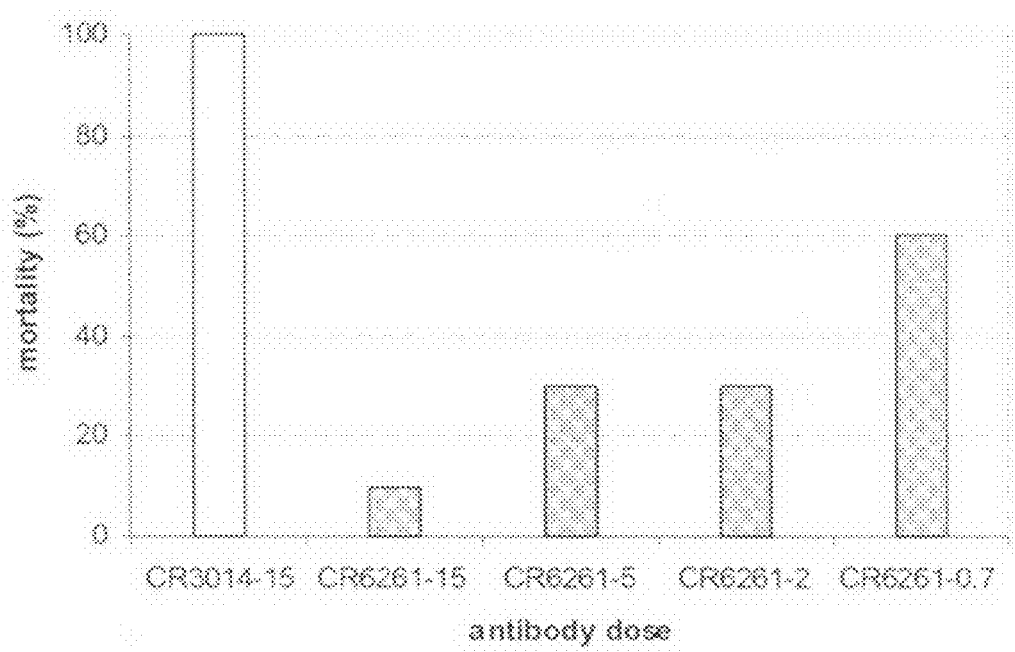
FIG. 5 shows the mortality rate in relation to the dose given of the anti-H5N1 antibodies in the study of FIGS. 2-4 (example 12).

FIG. 4 shows the number of mice surviving per group on each day. A clear dose-response relationship between the amount of antibody administered and average survival time was present. FIG. 5 shows the mortality in a dose-responsive manner. The first mice died 7 days after inoculation in the lowest dose group (0.7 mg/kg) and in the group of mice that received the negative control: CR3014. Less than 50% of the animals were protected against death when 0.7 mg/kg of CR6261 antibody was administered. However, 9 to 10 mice survived when the highest dose of antibody was administered. No mice of the negative control group (CR3014) survived, showing that indeed a 100% lethal challenge dose was used in this study.

To assess whether IgG antibodies are able to render complete protection against infection, an HI assay is performed with sera collected at day 21 from mice that had received 15 mg/kg of CR6261 (group 1). This data should indicate that the mice experienced an H5N1 infection albeit without clinical manifestation.

These results show that at least three human anti-H5N1 antibodies, identified and developed as disclosed herein (CR6261, CR6323 and CR6325) are each separately able to provide protection against a lethal dose of influenza H5N1 in vivo. A clear dose-response relationship between the amount of CR6261 antibody administered and average survival time was observed. The results show that each monoclonal anti-H5N1 IgG antibody tested was able to prevent clinical manifestation of H5N1 infection in mice when administered one day prior to infection at a dose of 15 mg/kg.

Example 13

Protective and Therapeutic Effects of Human Monoclonal Anti-H5N1 Antibodies Administered After an Infection with a Lethal Dose of Influenza H5N1 Virus In Vivo A study was performed to test the therapeutic effect of the monoclonal antibodies as disclosed herein, exemplified by CR6261, in a post-infection model, against a lethal H5N1 A/HK/97 influenza virus challenge in vivo. The virus batch and the type, and age of mice were the same as used in example 12. As a negative control one group of mice was injected with a non-relevant control antibody (CR2006). Clinical signs, weight loss and mortality were monitored until 21 days after infection.

58 female 7-week-old Balb/c mice were divided in 5 groups that received the antibody at different stages after infection, as follows:
1. 10 mice; 15 mg/kg CR6261 at 4 hr post infection
2. 14 mice; 15 mg/kg CR6261 at 1 day post infection
3. 10 mice; 15 mg/kg CR6261 at 2 days post infection
4. 10 mice; 15 mg/kg CR6261 at 3 days post infection
5. 14 mice; 15 mg/kg CR2006 at 1 day post infection All animals were acclimatized and maintained for a period of 6 days prior to the start of the study. The animals were inoculated intranasally on day 0 with 25 $LD_{50}$ of H5N1 influenza virus (approximately 50 µl), and monitored for 21 days. The actual dose of the virus administered was estimated by titrating a few replicate samples from the inoculum remaining after inoculation of the animals was completed. Virus titers (TCID50/mL) of the inoculum were determined on MDCK cells. The results showed that no inactivation of virus had unintentionally occurred during preparation or administration of the inoculum. At the specified time points after inoculation, 500 µl of antibody was administered by intraperitoneal injection. Group 5 acted as negative control. The animals in this group were injected with an irrelevant monoclonal antibody (CR2006) day 1 post-infection.

Clinical signs and weights were assessed each day from day −1 until day 21. Clinical signs were scored as described in example 12, with a scoring range from 0 to 4. Surviving animals were euthanised and bled on day 21. For assessment of pathological changes, 4 animals of group 2 and 5 were killed on day 6 after challenge. These animals were already pre-selected on day 0, and set apart from the others. For that reason, groups 2 and 5 started with 14 animals, with 10 mice remaining after the selection. Clinical signs and weights were assessed daily from day −1 until 21 days after virus inoculation.

Figure 6:
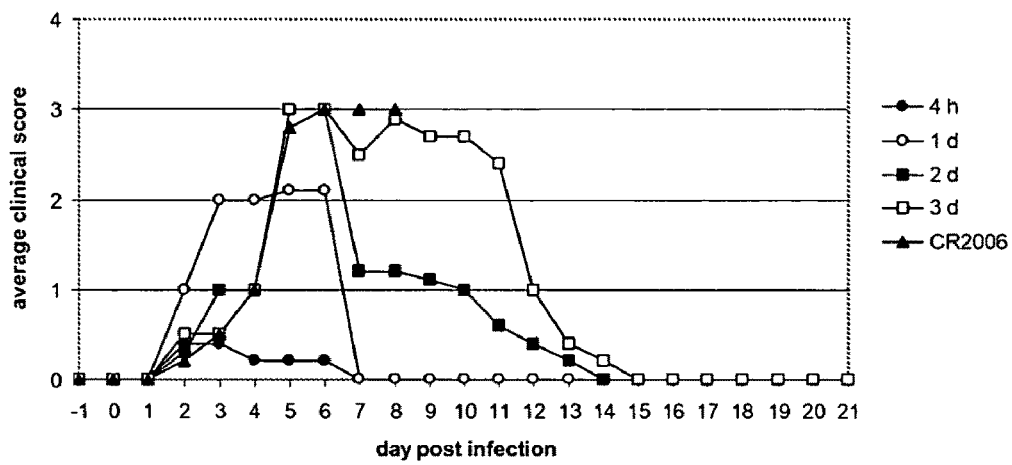
FIG. 6 shows the average clinical score per group of mice in a study (example 13) wherein mice were infected with a lethal dose of H5N1 influenza virus and treated at different time points after infection (4 hr, 1, 2 and 3 days) with CR6261 anti-H5N1 monoclonal antibody, or a non-related antibody CR2006 (administered at day 1 post-infection).
Figure 7:
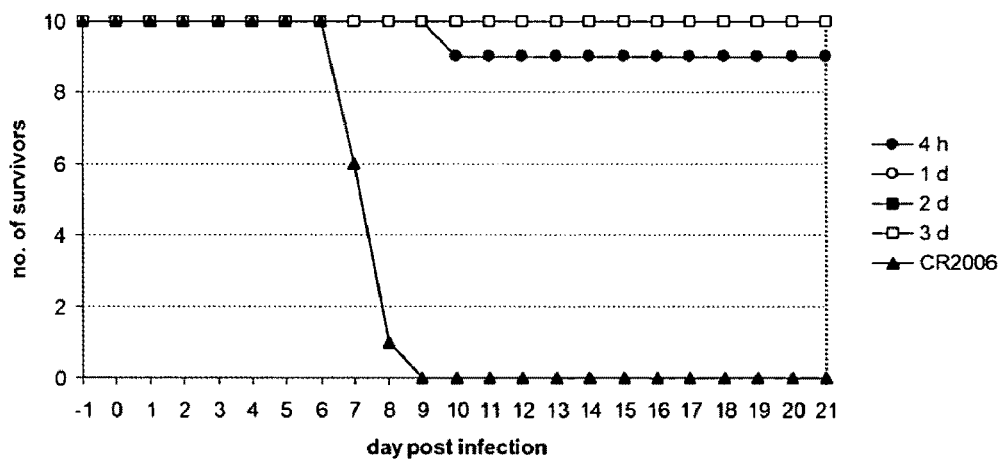
FIG. 7 shows the number of surviving animals in each group of the study described in FIG. 6. All animals of group 1-4, except for one animal in group 1 survived the entire study up to day 21 post-infection. All animals of group 5 had died at day 9.
Figure 8:
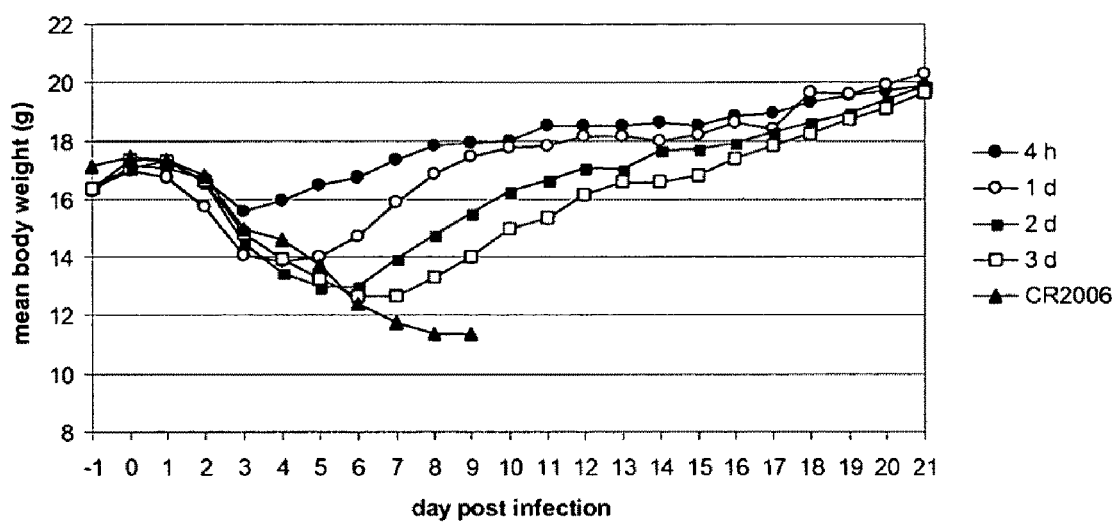
FIG. 8 shows the average body weight of the mice in each group during the study as described for FIG. 6. Measuring the body weight of the mice in group 5 stopped at day 9 as all mice in that group had died by that time. All remaining mice in groups 1-4 reached normal levels of body weight at day 21 post-infection, although it depended on the time of treatment how fast each group recovered.

All mice were active and appeared healthy without showing signs of disease during the acclimatization period. The average clinical score (total clinical score divided by number of surviving animals in each group) was calculated per day and the results are indicated in FIG. 6 (average clinical score per group), Table 16 (clinical scores) and Table 17 (respiratory distress). Clearly, all groups contained mice that showed clinical signs already at day 1 after infection. Depending on the time at which the antibody was administered, the clinical signs diminished and in all groups clinical signs were absent again at day 15. In the control group 5, all animals suffered from severe clinical signs and all animals had died, or were euthanized because they reached level 4 in the clinical scores, at day 9. This shows that again a lethal dose of influenza virus was administered to the animals. In Group 1, wherein the animals already received the antibody 4 hr after infection, some animals did not develop clinical signs, whereas others did. The number of animals that did exhibit clinical signs that could be scored are provided in Table 16. Since influenza virus can have a dramatic effect on the respiratory organs, also the respiratory distress was measured and here provided in Table 17. FIG. 7 and Table 18 show the number of surviving animals and the mortality rate respectively for all groups. For unknown reasons, one animal in group 1 that received the antibody 4 hr after infection died at day 10. All remaining animals in the groups that received the antibody after the influenza infection survived and were healthy at day 21. This is clearly shown in the body weight data that was obtained from all mice. FIG. 8 shows the mean body weight in each group of mice during the 21 days of the study. Although the body weight of all mice decreased upon infection, the body weight did return to normal levels after administration of the antibody. Clearly, the return to normal body weight levels depended on the timing of the antibody treatment, where animals that were treated 4 hr after exposure, recovered rapidly and reached normal levels at day 7, the animals that were treated 3 days after infection, reached their normal body weight at day 17. All animals reached a similar and healthy body weight at the end of the study, at day 21. Clearly, all animals that received the negative control antibody did not regain body weight and measurements stopped at death at day 9.

These results show that a post-infection treatment with a monoclonal antibody directed against H5N1 influenza virus, as disclosed herein and exemplified by antibody CR6261, can rescue mammalian subjects, as showed herein in mice, after challenge with a lethal dose of H5N1 influenza virus. Even at a late stage, 3 days post-infection, the antibody is able to reverse the clinical symptoms to a level in which no clinical signs could be monitored anymore. Strikingly, at day 21 post-infection, all antibody-treated animals reached normal body weight levels and did not show any remaining clinical signs.

Example 14

In Vivo Cross-Protection Against Lethal Challenge by Heterologous Influenza Subtypes Using Monoclonal Antibodies Directed Against HA of H5N1

As disclosed supra (example 11), some of the antibodies of the present invention apparently recognize a single epitope in the HA2 domain of the H5 haemagglutinin protein. In example 7 it was shown that certain binding molecules of the present invention could interact with the HA2 epitope in a non-conformational manner, in other words, the form in which the haemagglutinin protein is folded does not seem to hinder the neutralizing activity and the protective effects of these antibodies as disclosed herein.

The sequences of the influenza haemagglutinin protein parts that are not prone to antigenic drift (=the change of immunodominant regions within the HA1 region of the protein, resulting in the need for yearly updated influenza vaccines) are known in the art. The epitope in HA2 that is recognized by CR6261, CR6325 and CR6329 is contained in the amino acid sequence GVTNKVNSIIDK (SEQ ID NO:368, see Table 13) and is also present in the haemagglutinin proteins of H1 and H9 subtypes, see Table 22. It was shown in example 10 that interaction of the binding molecules of the present invention to the epitope was not limited to HA from H5, but that also HA from H1 and H9 were recognized (see Table 12). Hence, the binding molecules of the present invention recognize an epitope that is present in multiple HA proteins from different influenza serotypes.

To study the cross-applicability of these antibodies for therapy in vivo, an experiment was performed in mice that was in line with the dosing schedule of the experiment described in example 13. In the present experiment, a very high, lethal dose of another influenza virus related to the 1918 pandemic outbreak and now circulating seasonally in humans, namely H1N1, was administered in mice. Subsequently, the mice were treated with an antibody of the present invention, exemplified by CR6261, and clinical signs, respiratory distress and body weight were monitored for 3 weeks after infection. It turned out that these binding molecules that could rescue mice when infected with H5N1, were also able to rescue mammalian subjects when infected with H1N1, as outlined below.

A study was performed to test the therapeutic effect of the monoclonal antibodies, exemplified by CR6261, in a post-infection model against a lethal H1N1 A/WSN/33 influenza virus challenge in vivo. The virus batch was obtained from ATCC (VR-219) and was once propagated in embryonated eggs. The titre was 8.5 log $TCID_{50}$/ml. As a negative control one group of mice was injected with an irrelevant monoclonal antibody (IgG1, λ named 'CR57', isotype matched negative control antibody). Clinical signs, weight loss and mortality were monitored until 21 days after infection.

50 female 6 to 8-week-old Balb/c mice were divided in 5 groups that received the antibody at different stages related to the infection, as follows:
1. 10 mice; 15 mg/kg CR6261 at 1 day prior to infection
2. 10 mice; 15 mg/kg CR6261 at 1 day post infection
3. 10 mice; 15 mg/kg CR6261 at 2 days post infection
4. 10 mice; 15 mg/kg CR6261 at 3 days post infection
5. 10 mice; 15 mg/kg neg. contr. CR57 at 1 day post infection All animals were acclimatized and maintained for a period of at least 4 days prior to the start of the study. The animals were inoculated intranasally on day 0 with a lethal dose of H1N1 virus (6.6 log $TCID_{50}$; equivalent of 25× the $LD_{50}$) in approximately 50 µl, and monitored. At the specified time points before/after inoculation, 500 µl of antibody was administered by intraperitoneal injection. General health of the mice was monitored throughout the study. Clinical signs and weights were assessed each day from day-1 until day 21. Clinical signs were scored with the scoring rates as disclosed in example 12 and 13, ranging from 0 to 4. Surviving animals were euthanised and bled on day 21.

The mortality rate for each group is provided in Table 19, showing the number of living mice in each study group throughout the study. Two mice died shortly after the inoculation event (at day 1, one in group 2 and one in group 3) and were excluded from the analysis as pre-defined in the study plan. All mice in the control group 5 were dead at day 9 like in the previous study with H5N1 (see Table 18). The percentage of animals surviving this lethal challenge dose of H1N1 is also plotted in FIG. 9. The number of mice showing relevant clinical signs in each group is provided in Table 20. No clinical signs were observed in Group 1, whereas in Group 2, 3 and 4, some mice displayed clinical signs that disappeared completely after day 14 upon inoculation. All animals in Group 5 started showing clinical signs at day 2. No mice in this group recovered. The number of mice showing respiratory distress in category 2 or 3 is given in Table 21. No clinical distress was observed anymore after day 13 in Groups 1-4, whereas all remaining mice in control Group 5 did suffer from severe respiratory distress.

FIG. 10 shows the average body weight of the mice in each study group. Clearly, no measurements are provided for the mice in Group 5 after day 8. As can be seen from this figure, all mice that received the anti-H5N1 antibody and that recovered from the clinical signs did get to their expected body weight level at day 21.

The antibodies could protect these mice when administered before infection or after infection. Notably, the infection dose was rather high: 25× the $LD_{50}$ dose, indicating that the antibodies provide a very strong protection against the virus even when present at high titers in the lung. This is clinically relevant as highly pathogenic viruses like H5N1 replicate to high titer after infection and these high viral loads have been linked to the frequently severe outcome in infected humans. Moreover, all protected mice recovered completely from this lethal infection over time. It is concluded that the anti-H5N1 antibodies of the present invention (such as CR6261, CR6325, and CR6329) that bind to (single) epitopes in the HA2 region, a region that is not prone to antigenic drift, provide cross-protection in vivo against multiple influenza serotypes, circumventing the need for antibodies against the highly mutation-sensitive HA1 region. It is to be understood that the binding molecules of the present invention that are not limited by epitopes that are only present in HA from an H5 influenza serotype, can also be used in the prophylactic-, or therapeutic treatment of all influenza serotypes that contain the same epitope in the stable region of HA2, such as H1N1, and influenza viruses comprising H2, H6 and H9 haemagglutinin proteins.

Example 15

Affinity Studies

Affinity studies were performed using surface plasmon resonance analysis with a BIAcore3000 analytical system at 25° C. and 37° C., using HBS-EP (Biacore AB, Sweden) as running buffer at a flow rate of 75 µl/min. IgGs were immobilized on a research grade CM5 4-flow channel (Fc) sensor chip (Biacore AB, Sweden) using amine coupling. A varying amount of HA from an H5N1 virus (A/Vietnam/1203/2004) was injected to analyse the binding interaction between the HA protein and the immobilized IgGs. Regeneration using 20 mM NaOH was performed at the end of each measurement to remove bound HA, while leaving the immobilized IgG on the chip.

Affinity constants were determined for CR6261, CR6323 and CR6325 antibodies. Five concentrations in 4-fold dilutions of HA were injected (100 µl per injection), followed by a dissociation phase of 3600 sec, and regeneration using 10 µl 20 mM NaOH. The resulting data were fitted using a 1:1 (Langmuir) model. However, an accurate dissociation constant (KD) could not be calculated. This was due to extremely low dissociation rates at 25° C. (even with an extended measurement) leading to unacceptable error in the calculation. When the experiments were repeated at 37° C. discernible dissociation did occur but still not sufficiently enough to accurately measure the KD. Experiments are performed to establish a definitive KD for the antibodies. These are estimated to be at least in the single digit mM range and most likely in the pM range of affinity. These experiments show that the binding molecules of the present invention have a very high affinity for their epitope present in the HA protein of influenza virus.

Below, the details of the nucleic acid and amino acid sequences referred to herein as SEQ ID NO:58-143, SEQ ID NO:212-237, and SEQ ID NO:316-367 are provided.

SEQ ID NO: 58

```
gaggtgcagc tggtggagtc tggggctgag gtgaagaagc ctgggtcctc ggtgaaagtc      60
tcttgcaagg cttctggagg ccccttccgc agctatgcta tcagctgggt gcgacaggcc     120
cctggacaag ggcctgagtg gatgggaggg atcatccta tttttggtac aacaaaatac     180
gcaccgaagt tccagggcag agtcacgatt accgcggacg atttcgcggg cacagtttac     240
atggagctga gcagcctgcg atctgaggac acggccatgt actactgtgc gaaacatatg     300
gggtaccagg tgcgcgaaac tatggacgtc tggggcaaag gaccacggt caccgtctcg     360
agtgctagca ccaagggccc cagcgtgttc ccctggccc ccagcagcaa gagcaccagc     420
ggcggcacag ccgccctggg ctgcctggtg aaggactact cccgagcc cgtgaccgtg     480
agctggaaca gcggcgcctt gaccagcggc gtgcacacct tccccgccgt gctgcagagc     540
agcggcctgt acagcctgag cagcgtggtg accgtgccca gcagcagcct gggcacccag     600
acctacatct gcaacgtgaa ccacaagccc agcaacacca aggtggacaa acgcgtggag     660
cccaagagct gcgacaagac ccacacctgc ccccccctgcc ctgcccccga gctgctgggc     720
ggaccctccg tgttcctgtt ccccccaag cccaaggaca ccctcatgat cagccggacc     780
cccgaggtga cctgcgtggt ggtggacgtg agccacgagg accccgaggt gaagttcaac     840
tggtacgtgg acggcgtgga ggtgcacaac gccaagacca gccccgggaa ggagcagtac     900
aacagcacct accgggtggt gagcgtgctc accgtgctgc accaggactg gctgaacggc     960
aaggagtaca agtgcaaggt gagcaacaag gccctgcctg cccccatcga gaagaccatc    1020
agcaaggcca agggccagcc ccgggagccc caggtgtaca ccctgccccc cagccgggag    1080
gagatgacca agaaccaggt gtccctcacc tgtctggtga agggcttcta ccccagcgac    1140
atcgccgtgg agtgggagag caacggccag cccgagaaca actacaagac cacccccccct    1200
gtgctggaca gcgacggcag cttcttcctg tacagcaagc tcaccgtgga caagagccgg    1260
tggcagcagg gcaacgtgtt cagctgcagc gtgatgcacg aggccctgca caaccactac    1320
acccagaaga gcctgagcct gagccccggc aag                                 1353
```

SEQ ID NO: 59

```
E V Q L V E S G A E V K K P G S S V K V S C K A S G G P F R S Y A I S W V R
Q A P G Q G P E W M G G I I P I F G T T K Y A P K F Q G R V T I T A D D F A
G T V Y M E L S S L R S E D T A M Y Y C A K H M G Y Q V R E T M D V W G K G
T T V T V S S A S T K G P S V F P L A P S S K S T S G G T A A L G C L V K D
Y F P E P V T V S W N S G A L T S G V H T F P A V L Q S S G L Y S L S S V V
T V P S S S L G T Q T Y I C N V N H K P S N T K V D K R V E P K S C D K T H
T C P P C P A P E L L G G P S V F L F P P K P K D T L M I S R T P E V T C V
V V D V S H E D P E V K F N W Y V D G V E V H N A K T K P R E E Q Y N S T Y
R V V S V L T V L H Q D W L N G K E Y K C K V S N K A L P A P I E K T I S K
A K G Q P R E P Q V Y T L P P S R E E M T K N Q V S L T C L V K G F Y P S D
I A V E W E S N G Q P E N N Y K T T P P V L D S D G S F F L Y S K L T V D K
S R W Q Q G N V F S C S V M H E A L H N H Y T Q K S L S L S P G K
```

SEQ ID NO: 60

```
caggtccagc tggtgcagtc tggggctgag gtgaagaagc ctgggtcctc ggtgaaagtc      60
tcttgcaagg cttctggagg ccccttccgc agctatgcta tcagctgggt gcgacaggcc     120
cctggacaag ggcctgagtg gatgggaggg atcatccta tttttggtac aacaaaatac     180
gcaccgaagt tccagggcag agtcacgatt accgcggacg atttcgcggg cacagtttac     240
```

-continued

```
atggagctga gcagcctgcg atctgaggac acggccatgt actactgtgc gaaacatatg      300
gggtaccagg tgcgcgaaac tatggacgtc tggggcaaag gaccacggt caccgtctcg       360 agtgctagca ccaagggccc cagcgtgttc cccctggccc ccagcagcaa gagcaccagc      420
ggcggcacag ccgccctggg ctgcctggtg aaggactact ccccgagcc cgtgaccgtg       480 agctggaaca gcggcgcctt gaccagcggc gtgcacacct tccccgccgt gctgcagagc      540
agcggcctgt acagcctgag cagcgtggtg accgtgccca gcagcagcct gggcacccag      600
acctacatct gcaacgtgaa ccacaagccc agcaacacca aggtggacaa acgcgtggag      660
cccaagagct gcgacaagac ccacacctgc ccccccgtgcc ctgccccga gctgctgggc      720 ggaccctccg tgttcctgtt cccccccaag cccaaggaca ccctcatgat cagccggacc      780
cccgaggtga cctgcgtggt ggtggacgtg agccacgagg accccgaggt gaagttcaac      840
tggtacgtgg acggcgtgga ggtgcacaac gccaagacca gccccggga ggagcagtac       900 aacagcacct accgggtggt gagcgtgctc accgtgctgc accaggactg gctgaacggc      960
aaggagtaca agtgcaaggt gagcaacaag gccctgcctg cccccatcga gaagaccatc     1020
agcaaggcca agggccagcc ccgggagccc caggtgtaca ccctgccccc cagccgggag     1080
gagatgacca agaaccaggt gtccctcacc tgtctggtga agggcttcta ccccagcgac     1140
atcgccgtgg agtgggagag caacggccag cccgagaaca actacaagac cacccccct      1200 gtgctggaca gcgacggcag cttcttcctg tacagcaagc tcaccgtgga caagagccgg     1260
tggcagcagg gcaacgtgtt cagctgcagc gtgatgcacg aggccctgca caaccactac     1320
acccagaaga gcctgagcct gagccccggc aag                                   1353
```

SEQ ID NO: 61
```
Q V Q L V Q S G A E V K K P G S S V K V S C K A S G G P F R S Y A I S W V R

Q A P G Q G P E W M G G I I P I F G T T K Y A P K F Q G R V T I T A D D F A

G T V Y M E L S S L R S E D T A M Y Y C A K H M G Y Q V R E T M D V W G K G

T T V T V S S A S T K G P S V F P L A P S S K S T S G G T A A L G C L V K D

Y F P E P V T V S W N S G A L T S G V H T F P A V L Q S S G L Y S L S S V V

T V P S S S L G T Q T Y I C N V N H K P S N T K V D K R V E P K S C D K T H

T C P P C P A P E L L G G P S V F L F P P K P K D T L M I S R T P E V T C V

V V D V S H E D P E V K F N W Y V D G V E V H N A K T K P R E E Q Y N S T Y

R V V S V L T V L H Q D W L N G K E Y K C K V S N K A L P A P I E K T I S K

A K G Q P R E P Q V Y T L P P S R E E M T K N Q V S L T C L V K G F Y P S D

I A V E W E S N G Q P E N N Y K T T P P V L D S D G S F F L Y S K L T V D K

S R W Q Q G N V F S C S V M H E A L H N H Y T Q K S L S L S P G K
```

SEQ ID NO: 62
```
gaggtgcagc tggtggagtc tggggctgag gtgaagaagc ctgggtcctc ggtgaaagtc       60
tcttgcaagg cttctggagg ccccttccgc agctatgcta tcagctgggt gcgacaggcc      120
cctggacaag ggcctgagtg gatgggaggg atcatcccta tttttggtac aacaaaatac      180
gcaccgaagt tccagggcag agtcacgatt accgcggacg atttcgcggg cacagtttac      240
atggagctga gcagcctgcg atctgaggac acggccatgt actactgtgc gaaacatatg      300
gggtaccagg tgcgcgaaac tatggacgtc tggggcaaag gaccacggt caccgtctcg       360 agtgctagca ccaagggccc cagcgtgttc cccctggccc ccagcagcaa gagcaccagc      420
ggcggcacag ccgccctggg ctgcctggtg aaggactact ccccgagcc cgtgaccgtg       480 agctggaaca gcggcgcctt gaccagcggc gtgcacacct tccccgccgt gctgcagagc      540
```

-continued

```
agcggcctgt acagcctgag cagcgtggtg accgtgccca gcagcagcct gggcacccag      600
acctacatct gcaacgtgaa ccacaagccc agcaacacca aggtggacaa acgcgtggag      660
cccaagagct gcgacaagac ccacacctgc ccccctgcc ctgccccga gctgctgggc       720 ggaccctccg tgttcctgtt cccccccaag cccaaggaca ccctcatgat cagccggacc      780
cccgaggtga cctgcgtggt ggtggacgtg agccacgagg accccgaggt gaagttcaac      840
tggtacgtgg acggcgtgga ggtgcacaac gccaagacca gccccgggga ggagcagtac      900
aacagcacct accgggtggt gagcgtgctc accgtgctgc accaggactg gctgaacggc      960
aaggagtaca agtgcaaggt gagcaacaag gccctgcctg ccccatcga aagaccatc      1020 agcaaggcca agggccagcc ccgggagccc caggtgtaca ccctgccccc cagccgggag      1080
gagatgacca gaaccaggt gtccctcacc tgtctggtga agggcttcta ccccagcgac      1140
atcgccgtgg agtgggagag caacggccag cccgagaaca actacaagac caccccccct      1200
gtgctggaca gcgacggcag cttcttcctg tacagcaagc tcaccgtgga caagagccgg      1260
tggcagcagg gcaacgtgtt cagctgcagc gtgatgcacg aggccctgca caaccactac      1320
acccagaaga gcctgagcct gagccccggc aag                                  1353
```

SEQ ID NO: 63

```
E V Q L V E S G A E V K K P G S S V K V S C K A S G G P F R S Y A I S W V R
Q A P G Q G P E W M G G I I P I F G T T K Y A P K F Q G R V T I T A D D F A
G T V Y M E L S S L R S E D T A M Y Y C A K H M G Y Q V R E T M D V W G K G
T T V T V S S A S T K G P S V F P L A P S S K S T S G G T A A L G C L V K D
Y F P E P V T V S W N S G A L T S G V H T F P A V L Q S S G L Y S L S S V V
T V P S S S L G T Q T Y I C N V N H K P S N T K V D K R V E P K S C D K T H
T C P P C P A P E L L G G P S V F L F P P K P K D T L M I S R T P E V T C V
V V D V S H E D P E V K F N W Y V D G V E V H N A K T K P R E E Q Y N S T Y
R V V S V L T V L H Q D W L N G K E Y K C K V S N K A L P A P I E K T I S K
A K G Q P R E P Q V Y T L P P S R E E M T K N Q V S L T C L V K G F Y P S D
I A V E W E S N G Q P E N N Y K T T P P V L D S D G S F F L Y S K L T V D K
S R W Q Q G N V F S C S V M H E A L H N H Y T Q K S L S L S P G K
```

SEQ ID NO: 64

```
gaggtgcagc tggtggagtc tggggctgag gtgaagaagc ctgggtcctc ggtgaaagtc       60
tcttgcaagg cttctggagg ccccttccgc agctatgcta tcagctgggt gcgacaggcc      120
cctggacaag ggcctgagtg gatgggaggg atcatcccta ttttggtac aacaaaatac       180 gcaccgaagt ccagggcag agtcacgatt accgcggacg atttcgcggg cacagtttac      240
atggagctga gcagcctgcg atctgaggac acggccatgt actactgtgc aaaacatatg      300
gggtaccagg tgcgcgaaac tatggacgtc tggggcaaag ggaccacggt caccgtctcg      360
agtgctagca ccaagggccc cagcgtgttc ccctggccc ccagcagcaa gagcaccagc      420
ggcggcacag ccgccctggg ctgcctggtg aaggactact tccccgagcc cgtgaccgtg      480
agctggaaca gcggcgcctt gaccagcggc gtgcacacct tccccgccgt gctgcagagc      540
agcggcctgt acagcctgag cagcgtggtg accgtgccca gcagcagcct gggcacccag      600
acctacatct gcaacgtgaa ccacaagccc agcaacacca aggtggacaa acgcgtggag      660
cccaagagct gcgacaagac ccacacctgc ccccctgcc ctgccccga gctgctgggc       720 ggaccctccg tgttcctgtt cccccccaag cccaaggaca ccctcatgat cagccggacc      780
cccgaggtga cctgcgtggt ggtggacgtg agccacgagg accccgaggt gaagttcaac      840
```

```
tggtacgtgg acggcgtgga ggtgcacaac gccaagacca agccccggga ggagcagtac      900
aacagcacct accgggtggt gagcgtgctc accgtgctgc accaggactg gctgaacggc      960
aaggagtaca agtgcaaggt gagcaacaag gccctgcctg cccccatcga aagaccatc      1020 agcaaggcca agggccagcc ccgggagccc caggtgtaca ccctgccccc cagccgggag     1080
gagatgacca agaaccaggt gtccctcacc tgtctggtga agggcttcta ccccagcgac     1140
atcgccgtgg agtgggagag caacggccag cccgagaaca actacaagac cacccccct     1200 gtgctggaca gcgacggcag cttcttcctg tacagcaagc tcaccgtgga caagagccgg     1260
tggcagcagg gcaacgtgtt cagctgcagc gtgatgcacg aggccctgca caaccactac     1320
acccagaaga gcctgagcct gagccccggc aag                                   1353
```

```
                                                            SEQ ID NO: 65
E V Q L V E S G A E V K K P G S S V K V S C K A S G G P F R S Y A I S W V R

Q A P G Q G P E W M G G I I P I F G T T K Y A P K F Q G R V T I T A D D F A

G T V Y M E L S S L R S E D T A M Y Y C A K H M G Y Q V R E T M D V W G K G

T T V T V S S A S T K G P S V F P L A P S S K S T S G G T A A L G C L V K D

Y F P E P V T V S W N S G A L T S G V H T F P A V L Q S S G L Y S L S S V V

T V P S S S L G T Q T Y I C N V N H K P S N T K V D K R V E P K S C D K T H

T C P P C P A P E L L G G P S V F L F P P K P K D T L M I S R T P E V T C V

V V D V S H E D P E V K F N W Y V D G V E V H N A K T K P R E E Q Y N S T Y

R V V S V L T V L H Q D W L N G K E Y K C K V S N K A L P A P I E K T I S K

A K G Q P R E P Q V Y T L P P S R E E M T K N Q V S L T C L V K G F Y P S D

I A V E W E S N G Q P E N N Y K T T P P V L D S D G S F F L Y S K L T V D K

S R W Q Q G N V F S C S V M H E A L H N H Y T Q K S L S L S P G K
```

```
                                                            SEQ ID NO: 66
caggtacagc tgcagcagtc aggggctgag gtgaagaagc ctgggtcctc ggtgaaggtc        60
tcctgcaagg tttccggagt cattttcagc ggcagtgcga tcagctgggt gcgacaggcc      120
cctggacaag gccttgagtg gatgggaggg atcagccctc tctttggcac aacaaattac      180
gcacaaaagt tccagggcag agtcacgatt accgcggacc aatccacgaa cacaacctac      240
atggaggtga acagcctgag atatgaggac acggccgtgt atttctgtgc gcaggtccca      300
aaatattaca gtgagtacat ggacgtctgg ggcaaaggga ccacggtcac cgtctcgagt      360
gctagcacca agggcccag cgtgttcccc ctggcccca gcagcaagag caccagcggc      420
ggcacagccg ccctgggctg cctggtgaag gactacttcc ccgagccgt gaccgtgagc       480 tggaacagcg gcgccttgac cagcggcgtg cacaccttcc ccgccgtgct gcagagcagc     540
ggcctgtaca gcctgagcag cgtggtgacc gtgcccagca gcagcctggg cacccagacc     600
tacatctgca acgtgaacca caagcccagc aacaccaagg tggacaaacg cgtggagccc     660
aagagctgcg acaagaccca cacctgcccc cctgccctg ccccgagct gctgggcgga      720 ccctccgtgt tcctgttccc ccccaagccc aaggacaccc tcatgatcag ccggaccccc     780
gaggtgacct gcgtggtggt ggacgtgagc cacgaggacc ccgaggtgaa gttcaactgg     840
tacgtggacg gcgtggaggt gcacaacgcc aagaccaagc ccgggagga gcagtacaac     900 agcacctacc gggtggtgag cgtgctcacc gtgctgcacc aggactggct gaacggcaag     960
gagtacaagt gcaaggtgag caacaaggcc ctgcctgccc ccatcgagaa gaccatcagc    1020
aaggccaagg gccagccccg ggagcccag gtgtacaccc tgccccccag ccgggaggag     1080
atgaccaaga accaggtgtc cctcacctgt ctggtgaagg gcttctaccc cagcgacatc    1140
```

```
gccgtggagt gggagagcaa cggccagccc gagaacaact acaagaccac ccccctgtg    1200 ctggacagcg acggcagctt cttcctgtac agcaagctca ccgtggacaa gagccggtgg    1260
cagcagggca acgtgttcag ctgcagcgtg atgcacgagg ccctgcacaa ccactacacc    1320
cagaagagcc tgagcctgag ccccggcaag                                     1350
```

SEQ ID NO: 67

```
Q V Q L Q Q S G A E V K K P G S S V K V S C K V S G V I F S G S A I S W V R

Q A P G Q G L E W M G G I S P L F G T T N Y A Q K F Q G R V T I T A D Q S T

N T T Y M E V N S L R Y E D T A V Y F C A R G P K Y Y S E Y M D V W G K G T

T V T V S S A S T K G P S V F P L A P S S K S T S G G T A A L G C L V K D Y

F P E P V T V S W N S G A L T S G V H T F P A V L Q S S G L Y S L S S V V T

V P S S S L G T Q T Y I C N V N H K P S N T K V D K R V E P K S C D K T H T

C P P C P A P E L L G G P S V F L F P P K P K D T L M I S R T P E V T C V V

V D V S H E D P E V K F N W Y V D G V E V H N A K T K P R E E Q Y N S T Y R

V V S V L T V L H Q D W L N G K E Y K C K V S N K A L P A P I E K T I S K A

K G Q P R E P Q V Y T L P P S R E E M T K N Q V S L T C L V K G F Y P S D I

A V E W E S N G Q P E N N Y K T T P P V L D S D G S F F L Y S K L T V D K S

R W Q Q G N V F S C S V M H E A L H N H Y T Q K S L S L S P G K
```

SEQ ID NO: 68

```
caggtccagc tggtacagtc tggggctgag gtgaagaagc ctgggtcctc ggtgaaggtc     60
tcctgcaagg cttctggagg caccttcagt agttatgcta tcagctgggt gcgacaggcc    120
cctggacaag gcttgagtg gatgggagga atcatgggta tgtttggcac aactaactac    180
gcacagaagt tccagggcag agtcacgatt accgcggacg aattcacgag cgcagcctac    240
atggagctga ggagcctgag atctgaggac acggccgtct actactgtgc gaggtctagt    300
ggttattacc ccgaatactt ccaggactgg ggccagggca ccctggtcac cgtctcgagt    360
gctagcacca agggcccag cgtgttcccc ctggcccca gcagcaagag caccagcggc    420
ggcacagccg ccctgggctg cctggtgaag gactacttcc ccgagccgt gaccgtgagc    480 tggaacagcg gcgccttgac cagcggcgtg cacaccttcc ccgccgtgct gcagagcagc    540
ggcctgtaca gcctgagcag cgtggtgacc gtgcccagca gcagcctggg cacccagacc    600
tacatctgca acgtgaacca caagcccagc aacaccaagg tggacaaacg cgtggagccc    660
aagagctgcg acaagaccca cacctgcccc cctgccctg cccccgagct gctgggcgga    720
ccctccgtgt tcctgttccc ccccaagccc aaggacaccc tcatgatcag ccggaccccc    780
gaggtgacct gcgtggtggt ggacgtgagc cacgaggacc ccgaggtgaa gttcaactgg    840
tacgtggacg gcgtggaggt gcacaacgcc aagaccaagc ccggggga gcagtacaac    900 agcacctacc gggtggtgag cgtgctcacc gtgctgcacc aggactggct gaacggcaag    960
gagtacaagt gcaaggtgag caacaaggcc ctgcctgccc catcgagaa gaccatcagc    1020 aaggccaagg gccagccccg ggagccccag gtgtacaccc tgcccccag ccgggaggag    1080 atgaccaaga accaggtgtc cctcacctgt ctggtgaagg gcttctaccc cagcgacatc    1140
gccgtggagt gggagagcaa cggccagccc gagaacaact acaagaccac ccccctgtg    1200 ctggacagcg acggcagctt cttcctgtac agcaagctca ccgtggacaa gagccggtgg    1260
cagcagggca acgtgttcag ctgcagcgtg atgcacgagg ccctgcacaa ccactacacc    1320
cagaagagcc tgagcctgag ccccggcaag                                     1350
```

SEQ ID NO: 69
QVQLVQSGAEVKKPGSSVKVSCKASGGTFSSYAISWVR
QAPGQGLEWMGGIMGMFGTTNYAQKFQGRVTITADEFT
SAAYMELRSLRSEDTAVYYCARSSGYYPEYFQDWGQGT
LVTVSSASTKGPSVFPLAPSSKSTSGGTAALGCLVKDY
FPEPVTVSWNSGALTSGVHTFPAVLQSSGLYSLSSVVT
VPSSSLGTQTYICNVNHKPSNTKVDKRVEPKSCDKTHT
CPPCPAPELLGGPSVFLFPFKPKDTLMISRTPEVTCVV
VDVSHEDPEVKFNWYVDGVEVHNAKTKPREEQYNSTYR
VVSVLTVLHQDWLNGKEYKCKVSNKALPAPIEKTISKA
KGQPREPQVYTLPPSREEMTKNQVSLTCLVKGFYPSDI
AVEWESNGQPENNYKTTPPVLDSDGSFFLYSKLTVDKS
RWQQGNVFSCSVMHEALHNHYTQKSLSLSPGK

SEQ ID NO: 70
```
caggtccagc tggtgcagtc tggggggaggc ctggtcaagc ctgggggggtc cctgagactc    60
tcctgtgcag cctctggatt caccttcagt agctatagca tgaactgggt ccgccaggct   120
ccagggaagg ggctggagtg ggtctcatcc attagtagta gtagtagtta catatactac   180
gtagactcag tgaagggccg attcaccatc tccagagaca cgccaagaa ctcactgtat   240
ctgcaaatga acagcctgag agccgaggac acggctgtgt attactgtgc gagaggtggt   300
gggagctacg ggcctacga aggctttgac tactggggcc agggcaccct ggtcaccgtc   360
tcgagtgcta gcaccaaggg ccccagcgtg ttccccctgg ccccccagcag caagagcacc   420
agcggcggca cagccgccct gggctgcctg gtgaaggact acttccccga gcccgtgacc   480
gtgagctgga acagcggcgc cttgaccagc ggcgtgcaca ccttccccgc cgtgctgcag   540
agcagcggcc tgtacagcct gagcagcgtg gtgaccgtgc cagcagcag cctgggcacc   600
cagacctaca tctgcaacgt gaaccacaag cccagcaaca ccaaggtgga caaacgcgtg   660
gagcccaaga gctgcgacaa gacccacacc tgcccccct gccctgcccc cgagctgctg   720
ggcggaccct ccgtgttcct gttccccccc aagcccaagg acaccctcat gatcagccgg   780
accccccagg tgacctgcgt ggtggtggac gtgagccacg aggaccccga ggtgaagttc   840
aactggtacg tggacggcgt ggaggtgcac aacgccaaga ccaagcccg ggaggagcag   900
tacaacagca cctaccgggt ggtgagcgtg ctcaccgtgc tgcaccagga ctggctgaac   960
ggcaaggagt acaagtgcaa ggtgagcaac aaggccctgc ctgcccccat cgagaagacc  1020
atcagcaagg ccaagggcca gccccgggag ccccaggtgt acaccctgcc ccccagccgg  1080
gaggagatga ccaagaacca ggtgtccctc acctgtctgg tgaagggctt ctaccccagc  1140
gacatcgccg tggagtggga gagcaacggc cagcccgaga caactacaa gaccaccccc  1200
cctgtgctgg acagcgacgg cagcttcttc ctgtacagca agctcaccgt ggacaagagc  1260
cggtggcagc agggcaacgt gttcagctgc agcgtgatgc acgaggccct gcacaaccac  1320
tacacccaga agagcctgag cctgagcccc ggcaag                             1356
```

SEQ ID NO: 71
QVQLVQSGGGLVKPGGSLRLSCAASGFTFSSYSMNWVR
QAPGKGLEWVSSISSSSSYIYYVDSVKGRFTISRDNAK
NSLYLQMNSLRAEDTAVYYCARGGGSYGAYEGFDYWGQ
GTLVTVSSASTKGPSVFPLAPSSKSTSGGTAALGCLVK

-continued

D Y F P E P V T V S W N S G A L T S G V H T F P A V L Q S S G L Y S L S S V

V T V P S S S L G T Q T Y I C N V N H K P S N T K V D K R V E P K S C D K T

H T C P P C P A P E L L G G P S V F L F P P K P K D T L M I S R T P E V T C

V V V D V S H E D P E V K F N W Y V D G V E V H N A K T K P R E E Q Y N S T

Y R V V S V L T V L H Q D W L N G K E Y K C K V S N K A L P A P I E K T I S

K A K G Q P R E P Q V Y T L P P S R E E M T K N Q V S L T C L V K G F Y P S

D I A V E W E S N G Q P E N N Y K T T P P V L D S D G S F F L Y S K L T V D

K S R W Q Q G N V F S C S V M H E A L H N H Y T Q K S L S L P G K

SEQ ID NO: 72

```
gaggtgcagc tggtggagtc tggggctgag gtgaagaagc ctgggtcctc ggtgaaagtc        60
tcttgcaagg cttctggagg ccccttccgc agctatgcta tcagctgggt gcgacaggcc       120
cctggacaag ggcctgagtg gatgggaggg atcatccctg ttttggtac aacaaaatac       180
gcaccgaagt tccagggcag agtcacgatt accgcggacg atttcgcggg cacagtttac       240
atggagctga gcagcctgcg atctgaggac acggccatgt actactgtgc gaaacatatg       300
gggtaccagg tgcgcgaaac tatggacgtc tggggcaaag ggaccacggt caccgtctcg       360
agtgctagca ccaagggccc cagcgtgttc cccctggccc ccagcagcaa gagcaccagc       420
ggcggcacag ccgccctggg ctgcctggtg aaggactact tccccgagcc cgtgaccgtg       480
agctggaaca gcggcgcctt gaccagcggc gtgcacacct tccccgccgt gctgcagagc       540
agcggcctgt acagcctgag cagcgtggtg accgtgccca gcagcagcct gggcacccag       600
acctacatct gcaacgtgaa ccacaagccc agcaacacca aggtggacaa acgcgtggag       660
cccaagagct gcgacaagac ccacacctgc cccccctgcc ctgccccga gctgctgggc       720
ggaccctccg tgttcctgtt ccccccaag cccaaggaca ccctcatgat cagccggacc       780
cccgaggtga cctgcgtggt ggtggacgtg agccacgagg accccgaggt gaagttcaac       840
tggtacgtgg acggcgtgga ggtgcacaac gccaagacca gccccggga ggagcagtac       900
aacagcacct accgggtggt gagcgtgctc accgtgctgc accaggactg gctgaacggc       960
aaggagtaca agtgcaaggt gagcaacaag gccctgcctg cccccatcga aagaccatc      1020
agcaaggcca agggccagcc ccgggagccc caggtgtaca ccctgccccc cagccgggag      1080
gagatgacca agaaccaggt gtccctcacc tgtctggtga agggcttcta ccccagcgac      1140
atcgccgtgg agtgggagag caacggccag cccgagaaca actacaagac cacccccct      1200
gtgctggaca gcgacggcag cttcttcctg tacagcaagc tcaccgtgga caagagccgg      1260
tggcagcagg gcaacgtgtt cagctgcagc gtgatgcacg aggccctgca caaccactac      1320
acccagaaga gcctgagcct gagccccggc aag                                   1353
```

SEQ ID NO: 73

E V Q L V E S G A E V K K P G S S V K V S C K A S G G P F R S Y A I S W V R

Q A P G Q G P E W M G G I I P I F G T T K Y A P K F Q G R V T I T A D D F A

G T V Y M E L S S L R S E D T A M Y Y C A K H M G Y Q V R E T M D V W G K G

T T V T V S S A S T K G P S V F P L A P S S K S T S G G T A A L G C L V K D

Y F P E P V T V S W N S G A L T S G V H T F P A V L Q S S G L Y S L S S V V

T V P S S S L G T Q T Y I C N V N H K P S N T K V D K R V E P K S C D K T H

T C P P C P A P E L L G G P S V F L F P P K P K D T L M I S R T P E V T C V

V V D V S H E D P E V K F N W Y V D G V E V H N A K T K P R E E Q Y N S T Y

R V V S V L T V L H Q D W L N G K E Y K C K V S N K A L P A P I E K T I S K

-continued
```
A K G Q P R E P Q V Y T L P P S R E E M T K N Q V S L T C L V K G F Y P S D

I A V E W E S N G Q P E N N Y K T T P P V L D S D G S F F L Y S K L T V D K

S R W Q Q G N V F S C S V M H E A L H N H Y T Q K S L S L S P G K
```

SEQ ID NO: 74

```
gaggtgcagc tggtggagtc tggggctgag gtgaagaagc ctgggtcctc ggtgaaagtc      60
tcttgcaagg cttctggagg ccccttccgc agctatgcta tcagctgggt gcgacaggcc     120
cctggacaag ggcctgagtg gatgggaggg atcatcccta tttttggtac aacaaaatac     180
gcaccgaagt tccagggcag agtcacgatt accgcggacg atttcgcggg cacagtttac     240
atggagctga gcagcctgcg atctgaggac acggccatgt actactgtgc gaaacatatg     300
gggtaccagg tgcgcgaaac tatggacgtc tggggcaaag ggaccacggt caccgtctcg     360
agtgctagca ccaagggccc cagcgtgttc ccctggccc ccagcagcaa gagcaccagc      420
ggcggcacag ccgccctggg ctgcctggtg aaggactact cccccgagcc cgtgaccgtg     480
agctggaaca gcggcgcctt gaccagcggc gtgcacacct tccccgccgt gctgcagagc     540
agcggcctgt acagcctgag cagcgtggtg accgtgccca gcagcagcct gggcacccag     600
acctacatct gcaacgtgaa ccacaagccc agcaacacca aggtggacaa acgcgtggag     660
cccaagagct gcgacaagac ccacacctgc ccccctgcc ctgcccccga gctgctgggc      720
ggaccctccg tgttcctgtt cccccccaag cccaaggaca ccctcatgat cagccggacc     780
cccgaggtga cctgcgtggt ggtggacgtg agccacgagg accccgaggt gaagttcaac     840
tggtacgtgg acggcgtgga ggtgcacaac gccaagacca gccccgggga ggagcagtac     900
aacagcacct accgggtggt gagcgtgctc accgtgctgc accaggactg gctgaacggc     960
aaggagtaca agtgcaaggt gagcaacaag gccctgcctg cccccatcga aagaccatc     1020
agcaaggcca agggccagcc ccgggagccc caggtgtaca ccctgccccc cagccgggag    1080
gagatgacca agaaccaggt gtccctcacc tgtctggtga agggcttcta ccccagcgac    1140
atcgccgtgg agtgggagag caacggccag cccgagaaca actacaagac caccccccct    1200
gtgctggaca gcgacggcag cttcttcctg tacagcaagc tcaccgtgga caagagccgg    1260
tggcagcagg gcaacgtgtt cagctgcagc gtgatgcacg aggccctgca caaccactac    1320
acccagaaga gcctgagcct gagccccggc aag                                 1353
```

SEQ ID NO: 75

```
E V Q L V E S G A E V K K P G S S V K V S C K A S G G P F R S Y A I S W V R

Q A P G Q G P E W M G G I I P I F G T T K Y A P K F Q G R V T I T A D D F A

G T V Y M E L S S L R S E D T A M Y Y C A K H M G Y Q V R E T M D V W G K G

T T V T V S S A S T K G P S V F P L A P S S K S T S G G T A A L G C L V K D

Y F P E P V T V S W N S G A L T S G V H T F P A V L Q S S G L Y S L S S V V

T V P S S S L G T Q T Y I C N V N H K P S N T K V D K R V E P K S C D K T H

T C P P C P A P E L L G G P S V F L F P P K P K D T L M I S R T P E V T C V

V V D V S H E D P E V K F N W Y V D G V E V H N A K T K P R E E Q Y N S T Y

R V V S V L T V L H Q D W L N G K E Y K C K V S N K A L P A P I E K T I S K

A K G Q P R E P Q V Y T L P P S R E E M T K N Q V S L T C L V K G F Y P S D

I A V E W E S N G Q P E N N Y K T T P P V L D S D G S F F L Y S K L T V D K

S R W Q Q G N V F S C S V M H E A L H N H Y T Q K S L S L S P G K
```

-continued

SEQ ID NO: 76

```
gaggtgcagc tggtggagtc tggggctgag gtgaagaagc cagggtcctc ggtgaaggtc        60
tcctgtaagg cctctggagg caccttctcc agctatggta tcagctgggt gcgacaggcc       120
cctggacaag ggcttgagtg gatgggagac atcatcggta tgtttggttc aacaaactac       180
gcacagaact tccagggcag actcacgatt accgcggacg aatccacgag cacagcctac       240
atggagctga gcagcctgag atctgaggac acggccgtgt attactgtgc gagaagtagt       300
ggttattacc ctgcatacct cccccactgg ggccagggca ccttggtcac cgtctcgagt       360
gctagcacca agggcccag cgtgttcccc ctggccccca gcagcaagag caccagcggc        420
ggcacagccg ccctgggctg cctggtcaag gactacttcc ccgagcccgt gaccgtgagc       480
tggaacagcg gcgccttgac cagcggcgtg cacaccttcc ccgccgtgct gcagagcagc       540
ggcctgtaca gcctgagcag cgtggtgacc gtgcccagca gcagcctggg cacccagacc       600
tacatctgca acgtgaacca caagcccagc aacaccaagg tggacaaacg cgtggagccc       660
aagagctgcg acaagaccca cacctgcccc cctgccctg cccccgagct gctgggcgga        720
ccctccgtgt tcctgttccc ccccaagccc aaggacaccc tcatgatcag ccggacccc        780 gaggtgacct gcgtggtggt ggacgtgagc cacgaggacc ccgaggtgaa gttcaactgg       840
tacgtggacg gcgtggaggt gcacaacgcc aagaccaagc cccgggagga gcagtacaac       900
agcacctacc gggtggtgag cgtgctcacc gtgctgcacc aggactggct gaacggcaag       960
gagtacaagt gcaaggtgag caacaaggcc ctgcctgccc ccatcgagaa gaccatcagc      1020
aaggccaagg gccagccccg ggagcccag gtgtacaccc tgcccccag ccgggaggag        1080 atgaccaaga accaggtgtc cctcacctgt ctggtgaagg gcttctaccc cagcgacatc      1140
gccgtggagt gggagagcaa cggccagccc gagaacaact acaagaccac ccccctgtg       1200 ctggacagcg acggcagctt cttcctgtac agcaagctca ccgtggacaa gagccggtgg      1260
cagcagggca acgtgttcag ctgcagcgtg atgcacgagg ccctgcacaa ccactacacc      1320
cagaagagcc tgagcctgag ccccggcaag                                      1350
```

SEQ ID NO: 77

```
E V Q L V E S G A E V K K P G S S V K V S C K A S G G T F S S Y G I S W V R
Q A P G Q G L E W M G D I I G M F G S T N Y A Q N F Q G R L T I T A D E S T
S T A Y M E L S S L R S E D T A V Y Y C A R S S G Y Y P A Y L P H W G Q G T
L V T V S S A S T K G P S V F P L A P S S K S T S G G T A A L G C L V K D Y
F P E P V T V S W N S G A L T S G V H T F P A V L Q S S G L Y S L S S V V T
V P S S S L G T Q T Y I C N V N H K P S N T K V D K R V E P K S C D K T H T
C P P C P A P E L L G G P S V F L F P P K P K D T L M I S R T P E V T C V V
V D V S H E D P E V K F N W Y V D G V E V H N A K T K P R E E Q Y N S T Y R
V V S V L T V L H Q D W L N G K E Y K C K V S N K A L P A P I E K T I S K A
K G Q P R E P Q V Y T L P P S R E E M T K N Q V S L T C L V K G F Y P S D I
A V E W E S N G Q P E N N Y K T T P P V L D S D G S F F L Y S K L T V D K S
R W Q Q G N V F S C S V M H E A L H N H Y T Q K S L S L P G K
```

SEQ ID NO: 78

```
gaggtgcagc tggtggagtc tggggctgag gtgaagaagc cggggtcctc ggtgaaggtc        60
tcctgcaagg cttctggagg caccttcagc ttctattcta tgagctgggt gcgacaggcc       120
cctggacaag gacttgagtg gatgggaggg atcatcccta tgtttggtac aacaaactac       180
gcacagaagt tccagggcag agtcacgatt accgcggtcg aatccacgag cacagcctac       240
```

-continued

```
atggaggtga gcagcctgag atctgaggac acggccgttt attactgtgc gagaggtgat      300
aagggtatct actactacta catggacgtc tggggcaaag ggaccacggt caccgtctcg      360
agtgctagca ccaagggccc cagcgtgttc ccctggccc ccagcagcaa gagcaccagc      420
ggcggcacag ccgccctggg ctgcctggtg aaggactact ccccgagcc cgtgaccgtg      480 agctggaaca gcggcgcctt gaccagcggc gtgcacacct tccccgccgt gctgcagagc      540
agcggcctgt acagcctgag cagcgtggtg accgtgccca gcagcagcct gggcacccag      600
acctacatct gcaacgtgaa ccacaagccc agcaacacca aggtggacaa acgcgtggag      660
cccaagagct gcgacaagac ccacacctgc ccccctgcc ctgcccccga gctgctgggc      720
ggaccctccg tgttcctgtt cccccccaag cccaaggaca ccctcatgat cagccggacc      780
cccgaggtga cctgcgtggt ggtggacgtg agccacgagg accccgaggt gaagttcaac      840
tggtacgtgg acggcgtgga ggtgcacaac gccaagacca gcccgggga ggagcagtac      900 aacagcacct accgggtggt gagcgtgctc accgtgctgc accaggactg gctgaacggc      960
aaggagtaca agtgcaaggt gagcaacaag gccctgcctg cccccatcga aagaccatc     1020 agcaaggcca agggccagcc ccgggagccc caggtgtaca ccctgccccc cagccgggag     1080
gagatgacca agaaccaggt gtccctcacc tgtctggtga agggcttcta ccccagcgac     1140
atcgccgtgg agtgggagag caacggccag cccgagaaca actacaagac cacccccct     1200 gtgctggaca gcgacggcag cttcttcctg tacagcaagc tcaccgtgga caagagccgg     1260
tggcagcagg gcaacgtgtt cagctgcagc gtgatgcacg aggccctgca caaccactac     1320
acccagaaga gcctgagcct gagccccggc aag                                  1353
```

SEQ ID NO: 79
E V Q L V E S G A E V K K P G S S V K V S C K A S G G T F S F Y S M S W V R

Q A P G Q G L E W M G G I I P M F G T T N Y A Q K F Q G R V T I T A V E S T

S T A Y M E V S S L R S E D T A V Y Y C A R G D K G I Y Y Y Y M D V W G K G

T T V T V S S A S T K G P S V F P L A P S S K S T S G G T A A L G C L V K D

Y F P E P V T V S W N S G A L T S G V H T F P A V L Q S S G L Y S L S S V V

T V P S S S L G T Q T Y I C N V N H K P S N T K V D K R V E P K S C D K T H

T C P P C P A P E L L G G P S V F L F P P K P K D T L M I S R T P E V T C V

V V D V S H E D P E V K F N W Y V D G V E V H N A K T K P R E E Q Y N S T Y

R V V S V L T V L H Q D W L N G K E Y K C K V S N K A L P A P I E K T I S K

A K G Q P R E P Q V Y T L P P S R E E M T K N Q V S L T C L V K G F Y P S D

I A V E W E S N G Q P E N N Y K T T P P V L D S D G S F F L Y S K L T V D K

S R W Q Q G N V F S C S V M H E A L H N H Y T Q K S L S L S P G K

SEQ ID NO: 80
```
gaggtgcagc tggtggagtc tggggctgag gtgaagaagc ctgggtcctc ggtgaaggtc       60
tcctgcaagg cttctggagg caccttcagc agctatgcta tcagctgggt gcgacaggcc      120
cctggacaag gcttgagtg gatgggaggg atcatcggta tgttcggtac agcaaactac      180
gcacagaagt tccagggcag agtcacgatt accgcggaca atttacgag cacagcctac      240 atggagctga gcagcctgag atctgaggac acggccgtgt attactgtgc gagaggaaat      300
tattactatg agagtagtct cgactactgg ggccaggaa ccctggtcac cgtctcgagt      360
gctagcacca agggcccag cgtgttcccc ctggcccca gcagcaagag caccagcggc      420
ggcacagccg ccctgggctg cctggtgaag gactacttcc ccgagccgt gaccgtgagc      480 tggaacagcg gcgccttgac cagcggcgtg cacaccttcc ccgccgtgct gcagagcagc      540
```

-continued

```
ggcctgtaca gcctgagcag cgtggtgacc gtgcccagca gcagcctggg cacccagacc      600
tacatctgca acgtgaacca caagcccagc aacaccaagg tggacaaacg cgtggagccc      660
aagagctgcg acaagaccca cacctgcccc cctgccctg ccccgagct gctgggcgga       720 cctccgtgt tcctgttccc ccccaagccc aaggacaccc tcatgatcag ccggaccccc      780
gaggtgacct gcgtggtggt ggacgtgagc cacgaggacc ccgaggtgaa gttcaactgg      840
tacgtggacg gcgtggaggt gcacaacgcc aagaccaagc ccgggagga gcagtacaac      900 agcacctacc gggtggtgag cgtgctcacc gtgctgcacc aggactggct gaacggcaag      960
gagtacaagt gcaaggtgag caacaaggcc ctgcctgccc ccatcgagaa gaccatcagc     1020
aaggccaagg gccagccccg ggagcccag gtgtacaccc tgcccccag ccgggaggag       1080 atgaccaaga accaggtgtc cctcacctgt ctggtgaagg gcttctaccc cagcgacatc     1140
gccgtggagt gggagagcaa cggccagccc gagaacaact acaagaccac ccccctgtg     1200 ctggacagcg acggcagctt cttcctgtac agcaagctca ccgtggacaa gagccggtgg     1260
cagcagggca acgtgttcag ctgcagcgtg atgcacgagg ccctgcacaa ccactacacc     1320
cagaagagcc tgagcctgag ccccggcaag                                      1350
```

SEQ ID NO: 81

```
E V Q L V E S G A E V K K P G S S V K V S C K A S G G T F S S Y A I S W V R

Q A P G Q G L E W M G G I I G M F G T A N Y A Q K F Q G R V T I T A D E F T

S T A Y M E L S S L R S E D T A V Y Y C A R G N Y Y Y E S S L D Y W G Q G T

L V T V S S A S T K G P S V F P L A P S S K S T S G G T A A L G C L V K D Y

F P E P V T V S W N S G A L T S G V H T F P A V L Q S S G L Y S L S S V V T

V P S S S L G T Q T Y I C N V N H K P S N T K V D K R V E P K S C D K T H T

C P P C P A P E L L G G P S V F L F P P K P K D T L M I S R T P E V T C V V

V D V S H E D P E V K F N W Y V D G V E V H N A K T K P R E E Q Y N S T Y R

V V S V L T V L H Q D W L N G K E Y K C K V S N K A L P A P I E K T I S K A

K G Q P R E P Q V Y T L P P S R E E M T K N Q V S L T C L V K G F Y P S D I

A V E W E S N G Q P E N N Y K T T P P V L D S D G S F F L Y S K L T V D K S

R W Q Q G N V F S C S V M H E A L H N H Y T Q K S L S L S P G K
```

SEQ ID NO: 82

```
caggtgcagc tggtgcagtc tggggctgag gtgaagaagc ctgggtcctc ggtgagagtc       60
tcctgcaagg cttctggaag catcttcaga aactatgcta tgagctgggt gcgacaggcc      120
cctggacaag ggcttgagtg gatgggaggg atcatcgcta tttttgggac accaaagtac      180
gcacagaagt tccagggcag agtcacgatt accgcggacg aatcgacgag cactgtctac      240
atggaactga gcggactgag atctgaggac acggccatgt attactgtgc gaggattccc      300
cactataatt ttggttcggg gagttatttc gactactggg gccagggaac cctggtcacc      360
gtctcgagtg ctagcaccaa gggcccagc gtgttccccc tggcccccag cagcaagagc       420
accagcggcg gcacagccgc cctgggctgc ctggtgaagg actacttccc cgagcccgtg      480
accgtgagct ggaacagcgg cgccttgacc agcggcgtgc acaccttccc cgccgtgctg      540
cagagcagcg gcctgtacag cctgagcagc gtggtgaccg tgcccagcag cagcctgggc      600
acccagacct acatctgcaa cgtgaaccac aagcccagca caccaaggt ggacaaacgc       660 gtggagccca gagctgcga caagacccac acctgccccc ctgccctgc cccgagctg       720 ctgggcggac cctccgtgtt cctgttccc cccaagccca aggacaccct catgatcagc      780 cggaccccg aggtgacctg cgtggtggtg gacgtgagcc acgaggaccc cgaggtgaag      840
```

```
ttcaactggt acgtggacgg cgtggaggtg cacaacgcca agaccaagcc ccgggaggag        900
cagtacaaca gcacctaccg ggtggtgagc gtgctcaccg tgctgcacca ggactggctg        960
aacggcaagg agtacaagtg caaggtgagc aacaaggccc tgcctgcccc catcgagaag       1020
accatcagca aggccaaggg ccagccccgg gagcccagg tgtacaccct gcccccagc        1080 cgggaggaga tgaccaagaa ccaggtgtcc ctcacctgtc tggtgaaggg cttctacccc       1140
agcgacatcg ccgtggagtg ggagagcaac ggccagcccg agaacaacta caagaccacc       1200 cccctgtgc tggacagcga cggcagcttc ttcctgtaca gcaagctcac cgtggacaag       1260
agccggtggc agcagggcaa cgtgttcagc tgcagcgtga tgcacgaggc cctgcacaac       1320
cactacaccc agaagagcct gagcctgagc cccggcaag                             1359
```

SEQ ID NO: 83

Q V Q L V Q S G A E V K K P G S S V R V S C K A S G S I F R N Y A M S W V R

Q A P G Q G L E W M G G I I A I F G T P K Y A Q K F Q G R V T I T A D E S T

S T V Y M E L S G L R S E D T A M Y Y C A R I P H Y N F G S G S Y F D Y W G

Q G T L V T V S S A S T K G P S V F P L A P S S K S T S G G T A A L G C L V

K D Y F P E P V T V S W N S G A L T S G V H T F P A V L Q S S G L Y S L S S

V V T V P S S S L G T Q T Y I C N V N H K P S N T K V D K R V E P K S C D K

T H T C P P C P A P E L L G G P S V F L F P P K P K D T L M I S R T P E V T

C V V V D V S H E D P E V K F N W Y V D G V E V H N A K T K P R E E Q Y N S

T Y R V V S V L T V L H Q D W L N G K E Y K C K V S N K A L P A P I E K T I

S K A K G Q P R E P Q V Y T L P P S R E E M T K N Q V S L T C L V K G F Y P

S D I A V E W E S N G Q P E N N Y K T T P P V L D S D G S F F L Y S K L T V

D K S R W Q Q G N V F S C S V M H E A L H N H Y T Q K S L S L S P G K

SEQ ID NO: 84

```
tcctatgtgc tgactcagcc acccctcagcg tctgggaccc ccgggcagag ggtcaccatc         60
tcttgttctg gaagcacgtt caacatcgga agtaatgctg tagactggta ccggcagctc        120
ccaggaacgg cccccaaact cctcatctat agtaataatc agcggccctc aggggtccct        180
gaccgattct ctggctccag gtctggcacc tcagcctccc tggccatcag tgggctccag        240
tctgaggatg aggctgatta ttactgtgca gcatgggatg acatcctgaa tgttccggta        300
ttcggcggag ggaccaagct gaccgtccta ggtgcggccg caggccagcc caaggccgct        360
cccagcgtga ccctgttccc cccctcctcc gaggagctgc aggccaacaa ggccaccctg        420
gtgtgcctca tcagcgactt ctaccctggc gccgtgaccg tggcctggaa ggcagacagc        480
agccccgtga aggcgggcgt ggagaccacc acccccagca gcagagcaa caacaagtac        540 gccgccagca gctacctgag cctcacccccc gagcagtgga gagccaccg gagctacagc        600 tgccaggtga cccacgaggg cagcaccgtg gagaagaccg tggcccccac cgagtgcagc        660
```

SEQ ID NO: 85

S Y V L T Q P P S A S G T P G Q R V T I S C S G S T F N I G S N A V D W Y R

Q L P G T A P K L L I Y S N N Q R P S G V P D R F S G S R S G T S A S L A I

S G L Q S E D E A D Y Y C A A W D D I L N V P V F G G G T K L T V L G A A A

G Q P K A A P S V T L F P P S S E E L Q A N K A T L V C L I S D F Y P G A V

T V A W K A D S S P V K A G V E T T T P S K Q S N N K Y A A S S Y L S L T P

E Q W K S H R S Y S C Q V T H E G S T V E K T V A P T E C S

SEQ ID NO: 86
```
cagtctgccc tgactcagcc tgccgccgtg tctgggtctc ctggacagtc gatcaccatc    60
tcctgcactg gaaccagcag tgacgttggt ggttataact atgtctcctg gtaccaacag   120
cacccaggca aagcccccaa actcatgatt tatgaggtca gtaatcggcc ctcaggggtt   180
tctaatcgct tctctggctc caagtctggc aacacggcct ccctgaccat ctctgggctc   240
caggctgagg acgaggctga ttattactgc agctcatata caagcagcag cacttatgtc   300
ttcggaactg ggaccaaggt caccgtccta ggtgcggccg caggccagcc caaggccgct   360
cccagcgtga ccctgttccc cccctcctcc gaggagctgc aggccaacaa ggccaccctg   420
gtgtgcctca tcagcgactt ctaccctggc gccgtgaccg tggcctggaa ggccgacagc   480
agccccgtga aggccggcgt ggagaccacc acccccagca gcagagcaa caacaagtac    540
gccgccagca gctacctgag cctcaccccc gagcagtgga gagccaccg gagctacagc    600
tgccaggtga cccacgaggg cagcaccgtg gagaagaccg tggcccccac cgagtgcagc   660
```

SEQ ID NO: 87
Q S A L T Q P A A V S G S P G Q S I T I S C T G T S S D V G G Y N Y V S W Y
Q Q H P G K A P K L M I Y E V S N R P S G V S N R F S G S K S G N T A S L T
I S G L Q A E D E A D Y Y C S S Y T S S S T Y V F G T G T K V T V L G A A A
G Q P K A A P S V T L F P P S S E E L Q A N K A T L V C L I S D F Y P G A V
T V A W K A D S S P V K A G V E T T T P S K Q S N N K Y A A S S Y L S L T P
E Q W K S H R S Y S C Q V T H E G S T V E K T V A P T E C S

SEQ ID NO: 88
```
tcctatgtgc tgactcagcc accctcagtc tctgggaccc ccgggcagag ggtcaccatc    60
tcttgctctg gaagccgctc caacgtcgga gataattctg tatattggta tcaacacgtc   120
ccagaaatgg ccccaaaact cctcgtctat aagaatacta acggccctc aggagtccct    180
gcccggtttt ccggctccaa gtctggcact tcagcctccc tggccatcat tggcctccag   240
tccggcgatg aggctgatta ttattgtgtg gcatgggatg acagcgtaga tggctatgtc   300
ttcggatctg ggaccaaggt caccgtccta ggtgcggccg caggccagcc caaggccgct   360
cccagcgtga ccctgttccc cccctcctcc gaggagctgc aggccaacaa ggccaccctg   420
gtgtgcctca tcagcgactt ctaccctggc gccgtgaccg tggcctggaa ggccgacagc   480
agccccgtga aggccggcgt ggagaccacc acccccagca gcagagcaa caacaagtac    540
gccgccagca gctacctgag cctcaccccc gagcagtgga gagccaccg gagctacagc    600
tgccaggtga cccacgaggg cagcaccgtg gagaagaccg tggcccccac cgagtgcagc   660
```

SEQ ID NO: 89
S Y V L T Q P P S V S G T P G Q R V T I S C S G S R S N V G D N S V Y W Y Q
H V P E M A P K L L V Y K N T Q R P S G V P A R F S G S K S G T S A S L A I
I G L Q S G D E A D Y Y C V A W D D S V D G Y V F G S G T K V T V L G A A A
G Q P K A A P S V T L F P P S S E E L Q A N K A T L V C L I S D F Y P G A V
T V A W K A D S S P V K A G V E T T T P S K Q S N N K Y A A S S Y L S L T P
E Q W K S H R S Y S C Q V T H E G S T V E K T V A P T E C S

SEQ ID NO: 90
```
cagtctgtgt tgacgcagcc gccctcagtg tctgcggccc aggacagaa ggtcaccatc     60
tcctgctctg gaagcagctc caacattggg aatgattatg tatcctggta ccagcagctc   120
ccaggaacag cccccaaact cctcatttat gacaataata gcgcaccctc aggggattcct  180
gaccgattct ctggctccaa gtctggcacg tcagccaccc tgggcatcac cggactccag   240
```

```
actggggacg aggccaacta ttactgcgca acatgggatc gccgcccgac tgcttatgtt      300
gtcttcggcg gagggaccaa gctgaccgtc ctaggtgcgg ccgcaggcca gcccaaggcc      360
gctcccagcg tgaccctgtt cccccctcc tccgaggagc tgcaggccaa caaggccacc       420
ctggtgtgcc tcatcagcga cttctaccct ggcgccgtga ccgtggcctg gaaggccgac      480
agcagccccg tgaaggccgg cgtggagacc accacccca gcaagcagag caacaacaag       540
tacgccgcca gcagctacct gagcctcacc cccgagcagt ggaagagcca ccggagctac      600
agctgccagg tgacccacga gggcagcacc gtggagaaga ccgtggcccc caccgagtgc      660
agc                                                                    663
```

SEQ ID NO: 91
Q S V L T Q P P S V S A A P G Q K V T I S C S G S S S N I G N D Y V S W Y Q
Q L P G T A P K L L I Y D N N K R P S G I P D R F S G S K S G T S A T L G I
T G L Q T G D E A N Y Y C A T W D R R P T A Y V V F G G G T K L T V L G A A
A G Q P K A A P S V T L F P P S S E E L Q A N K A T L V C L I S D F Y P G A
V T V A W K A D S S P V K A G V E T T T P S K Q S N N K Y A A S S Y L S L T
P E Q W K S H R S Y S C Q V T H E G S T V E K T V A P T E C S

SEQ ID NO: 92
```
gacatccaga tgacccagtc tccatcctcc ctgtctgcat ctgtaggaga cagagtcacc      60
atcacttgcc gggcgagtca gggcattagc agttatttag cctggtatca gcagaagcca      120
gggaaagttc ctacactcct gatctatgat gcatccactt tgcgatcagg ggtcccatct      180
cgcttcagtg gcagtggatc tgcgacagat ttcactctca ccatcagcag cctgcagcct      240
gaagatgttg caacttatta ctgtcaaagg tataacagtg cccccccgat caccttcggc      300
caagggacac gactggagat taaacgtgcg gccgcaccca gcgtgttcat cttccccccc      360
tccgacgagc agctgaagag cggcaccgcc agcgtggtgt gcctgctgaa caacttctac      420
ccccgggagg ccaaggtgca gtggaaggtg gacaacgccc tgcagagcgg caacagccag      480
gagagcgtga ccgagcagga cagcaaggac tccacctaca gcctgagcag caccctcacc      540
ctgagcaagg ccgactacga gaagcacaag gtgtacgcct gcgaggtgac ccaccagggc      600
ctgagcagcc ccgtgaccaa gagcttcaac cggggcgagt gt                         642
```

SEQ ID NO: 93
D I Q M T Q S P S S L S A S V G D R V T I T C R A S Q G I S S Y L A W Y Q Q
K P G K V P T L L I Y D A S T L R S G V P S R F S G S G S A T D F T L T I S
S L Q P E D V A T Y Y C Q R Y N S A P P I T F G Q G T R L E I K R A A A P S
V F I F P P S D E Q L K S G T A S V V C L L N N F Y P R E A K V Q W K V D N
A L Q S G N S Q E S V T E Q D S K D S T Y S L S S T L T L S K A D Y E K H K
V Y A C E V T H Q G L S S P V T K S F N R G E C

SEQ ID NO: 94
```
cagtctgtgc tgactcagcc accctcagag tccgtgtccc caggacagac agccagcgtc      60
acctgctctg gacataaatt gggggataaa tatgtttcgt ggtatcagca gaagccaggc      120
cagtcccctg tattactcat ctatcaagat aacaggcggc cctcagggat ccctgagcga      180
ttcataggct ccaactctgg gaacacagcc actctgacca tcagcgggac ccaggctctg      240
gatgaggctg actattactg tcaggcgtgg gacagcagca ctgcggtttt cggcggaggg      300
accaagctga ccgtcctagg tgcggccgca gccagcccaa ggccgctccc agcgtgacc      360
ctgttccccc cctcctccga ggagctgcag gccaacaagg ccaccctggt gtgcctcatc      420
agcgacttct accctggcgc cgtgaccgtg gcctggaagg ccgacagcag ccccgtgaag      480
```

```
gccggcgtgg agaccaccac ccccagcaag cagagcaaca acaagtacgc cgccagcagc        540
tacctgagcc tcaccccgga gcagtggaag agccaccgga gctacagctg ccaggtgacc        600
cacgagggca gcaccgtgga gaagaccgtg gcccccaccg agtgcagc                     648
```

SEQ ID NO: 95

```
Q S V L T Q P P S E S V S P G Q T A S V T C S G H K L G D K Y V S W Y Q Q

P G Q S P V L L I Y Q D N R R P S G I P E R F I G S N S G N T A T L T I S G

T Q A L D E A D Y Y C Q A W D S S T A V F G G G T K L T V L G A A A G Q P K

A A P S V T L F P P S S E E L Q A N K A T L V C L I S D F Y P G A V T V A W

K A D S S P V K A G V E T T T P S K Q S N N K Y A A S S Y L S L T P E Q W K

S H R S Y S C Q V T H E G S T V E K T V A P T E C S
```

SEQ ID NO: 96

```
gaaattgtgc tgactcagtc tccaggcacc ctgtctttgt ctccagggga aagagccacc         60
ctctcctgca gggccagtca gcgtgttagc agctacttag cctggtacca acagaaacct        120
ggccaggctc ccaggctcct catctatggt gcatccacca gggccgctgg catcccagac        180
aggttcagtg gcagtgggtc tgggacagac ttcactctca ccatcagcag actggagcct        240
gaagattctg cagtgtatta ctgtcagcag tatggtagga caccgctcac tttcggcgga        300
gggaccaagg tggagatcaa acgtgcggcc gcacccagcg tgttcatctt cccccctcc         360 gacgagcagc tgaagagcgg caccgccagc gtggtgtgcc tgctgaacaa cttctacccc        420
cgggaggcca aggtgcagtg gaaggtggac aacgccctgc agagcggcaa cagccaggag        480
agcgtgaccg agcaggacag caaggactcc acctacagcc tgagcagcac cctcaccctg        540
agcaaggccg actacgagaa gcacaaggtg tacgcctgcg aggtgaccca ccagggcctg        600
agcagccccg tgaccaagag cttcaaccgg ggcgagtgt                              639
```

SEQ ID NO: 97

```
E I V L T Q S P G T L S L S P G E R A T L S C R A S Q R V S S Y L A W Y Q Q

K P G Q A P R L L I Y G A S T R A A G I P D R F S G S G S G T D F T L T I S

R L E P E D S A V Y Y C Q Q Y G R T P L T F G G G T K V E I K R A A A P S V

F I F P P S D E Q L K S G T A S V V C L L N N F Y P R E A K V Q W K V D N A

L Q S G N S Q E S V T E Q D S K D S T Y S L S S T L T L S K A D Y E K H K V

Y A C E V T H Q G L S S P V T K S F N R G E C
```

SEQ ID NO: 98

```
tcctatgtgc tgactcagcc accctcggtg tcagtggccc aggacagac ggccaggatt         60 acctgtgggg gaaacaacat tggaagtaaa agtgtgcact ggtaccagca gaagccaggc        120
caggcccctg tgctggtcgt ctatgatgat agcgaccggc cctcagggat ccctgagcga        180
ttctctggct ccaactctgg gaacacggcc accctgacca tcagcagggt cgaagcgggg        240
gatgaggccg actattactg tcaggtgtgg gatagtagta gtgatcatgc tgtgttcgga        300
ggaggcaccc agctgaccgt cctcggtgcg ccgcaggcc agcccaaggc cgctcccagc         360
gtgaccctgt tcccccctc ctccgaggag ctgcaggcca caaggccac cctggtgtgc         420 ctcatcagcg acttctaccc tggcgccgtg accgtggcct ggaaggccga cagcagcccc       480
gtgaaggccg gcgtggagac caccacccc agcaagcaga gcaacaacaa gtacgccgcc       540
agcagctacc tgagcctcac ccccgagcag tggaagagcc accggagcta cagctgccag       600
gtgacccacg agggcagcac cgtggagaag accgtggccc ccaccgagtg cagc              654
```

SEQ ID NO: 99
S Y V L T Q P P S V S V A P G Q T A R I T C G G N N I G S K S V H W Y Q Q K
P G Q A P V L V V Y D D S D R P S G I P E R F S G S N S G N T A T L T I S R
V E A G D E A D Y Y C Q V W D S S S D H A V F G G G T Q L T V L G A A A G Q
P K A A P S V T L F P P S S E E L Q A N K A T L V C L I S D F Y P G A V T V
A W K A D S S P V K A G V E T T T P S K Q S N N K Y A A S S Y L S L T P E Q
W K S H R S Y S C Q V T H E G S T V E K T V A P T E C S

SEQ ID NO: 100
tcctatgtgc tgactcagcc accctcagcg tctgggaccc ccgggcagag ggtcaccatc 60
tcttgttctg gaagcagctc aacatcgga agtaattatg tatactggta ccagcagctc 120
ccaggcacgg cccccaaact cctcatctat agggatggtc agcggccctc agggtgtccct 180
gaccgattct ctggctccaa gtctggcacc tcagcctccc tggccatcag tggactccgg 240
tccgatgatg aggctgatta ttactgtgca acatgggatg acaacctgag tggtccagta 300
ttcggcggag ggaccaagct gaccgtccta ggtgcgccg caggcagcc caaggccgct 360
cccagcgtga ccctgttccc ccctcctcc gaggagctgc aggccaacaa ggccaccctg 420
gtgtgcctca tcagcgactt ctaccctggc gccgtgaccg tggcctggaa ggcagacagc 480
agccccgtga aggccggcgt ggagaccacc acccccagca gcagagcaa caacaagtac 540
gccgccagca gctacctgag cctcaccccc gagcagtgga gagccaccg gagctacagc 600
tgccaggtga cccacgaggg cagcaccgtg gagaagaccg tggcccccac cgagtgcagc 660

SEQ ID NO: 101
S Y V L T Q P P S A S G T P G Q R V T I S C S G S S S N I G S N Y V Y W Y Q
Q L P G T A P K L L I Y R D G Q R P S G V P D R F S G S K S G T S A S L A I
S G L R S D D E A D Y Y C A T W D D N L S G P V F G G G T K L T V L G A A A
G Q P K A A P S V T L F P P S S E E L Q A N K A T L V C L I S D F Y P G A V
T V A W K A D S S P V K A G V E T T T P S K Q S N N K Y A A S S Y L S L T P
E Q W K S H R S Y S C Q V T H E G S T V E K T V A P T E C S

SEQ ID NO: 102
gaaattgtgt tgacccagtc tccaggcacc ctgtctttgt ctccagggga aagagccacc 60
ctctcctgca gggccagtca gagtgttagc agcagctact tagcctggta ccagcagaaa 120
cctggccagg ctcccaggct cctcatctat ggtgcatcca gcagggccac tggcatccca 180
gacaggttca gtggcagtgg gtctgggaca gacttcactc tcaccatcag cagactggag 240
cctgaagatt ttgcagtgta ttactgtcag cagtatggta gctcacccag aactttcggc 300
ggagggacca aggtggagat caaacgtgcg ccgcacccca gcgtgttcat cttcccccc 360
tccgacgagc agctgaagag cggcaccgcc agcgtggtgt gcctgctgaa caacttctac 420
ccccgggagg ccaaggtgca gtggaaggtg gacaacgccc tgcagagcgg caacagccag 480
gagagcgtga ccgagcagga cagcaaggac tccacctaca gcctgagcag caccctcacc 540
ctgagcaagg ccgactacga aagcacaag gtgtacgcct gcgaggtgac ccaccagggc 600
ctgagcagcc ccgtgaccaa gagcttcaac cggggcgagt gt 642

SEQ ID NO: 103
E I V L T Q S P G T L S L S P G E R A T L S C R A S Q S V S S S Y L A W Y Q
Q K P G Q A P R L L I Y G A S S R A T G I P D R F S G S G S G T D F T L T I
S R L E P E D F A V Y Y C Q Q Y G S S P R T F G G G T K V E I K R A A A P S
V F I F P P S D E Q L K S G T A S V V C L L N N F Y P R E A K V Q W K V D N

-continued

A L Q S G N S Q E S V T E Q D S K D S T Y S L S S T L T L S K A D Y E K H K

V Y A C E V T H Q G L S S P V T K S F N R G E C

SEQ ID NO: 104

```
cagtctgccc tgactcagcc tgcctccgtg tctgggtctc ctggacagtc gatcaccatc    60
tcctgcactg gaaccagcag tgacgttggt ggttataact atgtctcctg gtaccaacag   120
cacccaggca aagcccccaa actcatgatt tatgaggtca gtaatcggcc ctcaggggtt   180
tctaatcgct tctctggctc caagtctggc aacacggcct ccctgaccat ctctgggctc   240
caggctgagg acgaggctga ttattactgc agctcatata caagcagcag cactcttgtc   300
ttcggaactg ggaccaaggt caccgtccta ggtgcggccg caggccagcc caaggccgct   360
cccagcgtga ccctgttccc ccctcctcc gaggagctgc aggccaacaa ggccaccctg   420
gtgtgcctca tcagcgactt ctaccctggc gccgtgaccg tggcctggaa ggccgacagc   480
agccccgtga aggccggcgt ggagaccacc acccccagca gcagagcaa caacaagtac   540
gccgccagca gctacctgag cctcaccccc gagcagtgga gagccaccg gagctacagc   600
tgccaggtga cccacgaggg cagcaccgtg gagaagaccg tggccccac cgagtgcagc   660
```

SEQ ID NO: 105

Q S A L T Q P A S V S G S P G Q S I T I S C T G T S S D V G G Y N Y V S W Y

Q Q H P G K A P K L M I Y E V S N R P S G V S N R F S G S K S G N T A S L T

I S G L Q A E D E A D Y Y C S S Y T S S S T L V F G T G T K V T V L G A A A

G Q P K A A P S V T L F P P S S E E L Q A N K A T L V C L I S D F Y P G A V

T V A W K A D S S P V K A G V E T T T P S K Q S N N K Y A A S S Y L S L T P

E Q W K S H R S Y S C Q V T H E G S T V E K T V A P T E C S

SEQ ID NO: 106

```
cagtctgtcg tgacgcagcc gccctcggtg tcagtggccc caggacagac ggccaggatt    60
acctgtgggg gaaacaacat tggaagtaaa agtgtgcact ggtaccagca gaagccaggc   120
caggcccctg tgctggtcgt ctatgatgat agcgaccggc cctcaggat ccctgagcga   180
ttctctggct ccaactctgg gaacacggcc accctgacca tcagcagggt cgaagccggg   240
gatgaggcca ctattactg tcaggtgtgg gatagtagta gtgatcatta tgtcttcgga   300
actgggacca aggtcaccgt cctaggtgcg gccgcaggcc agcccaaggc cgctcccagc   360
gtgaccctgt tcccccctc ctccgaggag ctgcaggcca caaggccac cctggtgtgc   420
ctcatcagcg acttctaccc tggcgccgtg accgtggcct ggaaggccga cagcagcccc   480
gtgaaggccg gcgtggagac caccaccccc agcaagcaga gcaacaacaa gtacgccgcc   540
agcagctacc tgagcctcac ccccgagcag tggaagagcc accggagcta cagctgccag   600
gtgacccacg agggcagcac cgtggagaag accgtggccc ccaccgagtg cagc          654
```

SEQ ID NO: 107

Q S V V T Q P P S V S V A P G Q T A R I T C G G N N I G S K S V H W Y Q Q K

P G Q A P V L V V Y D D S D R P S G I P E R F S G S N S G N T A T L T I S R

V E A G D E A D Y Y C Q V W D S S S D H Y V F G T G T K V T V L G A A A G Q

P K A A P S V T L F P P S S E E L Q A N K A T L V C L I S D F Y P G A V T V

A W K A D S S P V K A G V E T T T P S K Q S N N K Y A A S S Y L S L T P E Q

W K S H R S Y S C Q V T H E G S T V E K T V A P T E C S

SEQ ID NO: 108

```
actgtgttga cacagccgcc ctcagtgtct ggggcccag gcagagggt caccatctcc    60
tgcactggga gcagctccaa catcggggca ggttatgatg tacactggta ccagcagctt   120
```

```
ccaggaacag ccccaaaact cctcatctat ggtaacagca atcggccctc agggtccct      180 gaccgattct ctggctccaa gtctggcacg tcagccaccc tgggcatcac cggactccag      240
actggggacg aggccgatta ttactgcgga acatgggata gcagcctgag tgcttatgtc      300
ttcggaactg ggaccaaggt caccgtccta ggtgcggccg caggccagcc caaggccgct      360
cccagcgtga ccctgttccc ccctcctcc gaggagctgc aggccaacaa ggccaccctg      420
gtgtgcctca tcagcgactt ctaccctggc gccgtgaccg tggcctggaa ggccgacagc      480
agccccgtga aggccggcgt ggagaccacc accccccagca agcagagcaa caacaagtac      540
gccgccagca gctacctgag cctcaccccc gagcagtgga gagccaccg gagctacagc      600 tgccaggtga cccacgaggg cagcaccgtg gagaagaccg tggcccccac cgagtgcagc      660
```

SEQ ID NO: 109
T V L T Q P P S V S G A P G Q R V T I S C T G S S S N I G A G Y D V H W Y Q

Q L P G T A P K L L I Y G N S N R P S G V P D R F S G S K S G T S A T L G I

T G L Q T G D E A D Y Y C G T W D S S L S A Y V F G T G T K V T V L G A A A

G Q P K A A P S V T L F P P S S E E L Q A N K A T L V C L I S D F Y P G A V

T V A W K A D S S P V K A G V E T T T P S K Q S N N K Y A A S S Y L S L T P

E Q W K S H R S Y S C Q V T H E G S T V E K T V A P T E C S

SEQ ID NO: 110
M E K I V L L F A I V S L V K S D Q I C I G Y H A N N S T E Q V D T I M E K

N V T V T H A Q D I L E K K H N G K L C D L D G V K P L I L R D C S V A G W

L L G N P M C D E F I N V P E W S Y I V E K A N P V N D L C Y P G D F N D Y

E E L K H L L S R I N H F E K I Q I I P K S S W S S H E A S L G V S S A C P

Y Q G K S S F F R N V V W L I K K N S T Y P T I K R S Y N N T N Q E D L L V

L W G I H H P N D A A E Q T K L Y Q N P T T Y I S V G T S T L N Q R L V P R

I A T R S K V N G Q S G R M E F F W T I L K P N D A I N F E S N G N F I A P

E Y A Y K I V K K G D S T I M K S E L E Y G N C N T K C Q T P M G A I N S S

M P F H N I H P L T I G E C P K Y V K S N R L V L A T G L R N S P Q R E R R

R K K R G L F G A I A G F I E G G W Q G M V D G W Y G Y H H S N E Q G S G Y

A A D K E S T Q K A I D G V T N K V N S I I D K M N T Q F E A V G R E F N N

L E R R I E N L N K K M E D G F L D V W T Y N A E L L V L M E N E R T L D F

H D S N V K N L Y D K V R L Q L R D N A K E L G N G C F E F Y H K C D N E C

M E S V R N G T Y D Y P Q Y S E E A R L K R E E I S G V K L E S I G I Y Q I

L S I Y S T V A S S L A L A I M V A G L S L W M C S N G S L Q C R

SEQ ID NO: 111
M E K I V L L F A I V S L V K S D Q I C I G Y H A N N S T E Q V D T I M E K

N V T V T H A Q D I L E K T H N G K L C D L D G V K P L I L R D C S V A G W

L L G N P M C D E F I N V P E W S Y I V E K A N P V N D L C Y P G D F N D Y

E E L K H L L S R I N H F E K I Q I I P K S S W S S H E A S L G V S S A C P

Y Q G K S S F F R N V V W L I K K N S T Y P T I K R S Y N N T N Q E D L L V

L W G I H H P N D A A E Q T K L Y Q N P T T Y I S V G T S T L N Q R L V P R

I A T R S K V N G Q S G R M E F F W T I L K P N D A I N F E S N G N F I A P

E Y A Y K I V K K G D S T I M K S E L E Y G N C N T K C Q T P M G A I N S S

M P F H N I H P L T I G E C P K Y V K S N R L V L A T G L R N S P Q R E R R

```
RKKRGLFGAIAGFIEGGWQGMVDGWYGYHHSNEQGSY
AADKESTQKAIDGVTNKVNSIIDKMNTQFEAVGREFNN
LERRIENLNKKMEDGFLDVWTYNAELLVLMENERTLDF
HDSNVKNLYDKVRLQLRDNAKELGNGCFEFYHKCDNEC
MESVRNGTYDYPQYSEEARLKREEISGVKLESIGIYQI
LSIYSTVASSLALAIMVAGLSLWMCSNGSLQCR
```

SEQ ID NO: 112
```
MEKIVLLLAIVSLVKSDQICIGYHANNSTEQVDTIMEK
NVTVTHAQDILEKTHNGKLCDLDGVKPLILRDCSVAGW
LLGNPMCDEFINVPEWSYIVEKANPANDLCYPGNFNDY
EELKHLLSRINHFEKIQIIPKSSWSDHEASSGVSSACP
YQGKSSFFRNVVWLIKKNSSYPTIKRSYNNTNQEDLLV
LWGIHHPNDAAEQTRLYQNPTTYISVGTSTLNQRLVPK
IATRSKVNGQSGRMEFFWTILKPNDAINFESNGNFIAP
EYAYKIVKKGDSAIMKSELEYGNCNTKCQTPMGAINSS
MPFHNIHPLTIGECPKYVKSNRLVLATGLRNSPQRERR
RKKRGLFGAIAGFIEGGWQGMVDGWYGYHHSNEQGSY
AADKESTQKAIDGVTNKVNSIIDKMNTQFEAVGREFNN
LERRIENLNKKMEDGFLDVWTYNAELLVLMENERTLDF
HDSNVKNLYDKVRLQLRDNAKELGNGCFEFYHKCDNEC
MESVRNGTYDYPQYSEEARLKREEISGVKLESIGIYQI
LSIYSTVASSLALAIMVAGLSLWMCSNGSLQCR
```

SEQ ID NO: 113
```
MEKIVLLFAIVSLVKSDQICIGYHANNSTEQVDTIMEK
NVTVTHAQDILEKTHNGKLCDLDGVKPLILRDCSVAGW
LLGNPMCDEFINVPEWSYIVEKANPVDLCYPGDFNDY
EELKHLLSRINHFEKIQIIPKSSWSSHEASLGVSSACP
YQGKSSFFRNVVWLIKKNSTYPTIKRSYNNTNQEDLLV
LWGIHHPNDAAEQTKLYQNPTTYISVGTSTLNQRLVPR
IATRSKVNGQSGRMEFFWTILKPNDAINFESNGNFIAP
EYAYKIVKKGDSTIMKSELEYGNCNTKCQTPMGAINSS
MPFHNIHPLTIGECPKYVKSNRLVLATGLRNSPQRERR
RKKRGLFGAIAGFIEGGWQGMVDGWYGYHHSNEQGSY
AADKESTQKAIDGVTNKVNSIIDKMNTQFEAVGREFNN
LERRIENLNKKMEDGFLDVWTYNAELLVLMENERTLDF
HDSNVKNLYDKVRLQLRDNAKELGNGCFEFYHKCDNEC
MESVRNGTYDYPQYSEEARLKREEISGVKLESIGIYQI
QHSGGRSSLEGPRFEQKLISEEDLNMHTGHHHHHH
```

SEQ ID NO: 114
```
MEKIVLLLAIVSLVKSDQICIGYHANNSTEQVDTIMEK
NVTVTHAQDILEKTHNGKLCDLDGVKPLILRDCSVAGW
LLGNPMCDEFINVPEWSYIVEKANPANDLCYPGNFNDY
```

-continued

E E L K H L L S R I N H F E K I Q I I P K S S W S D H E A S S G V S S A C P

Y Q G K S S F F R N V V W L I K K N S S Y P T I K R S Y N N T N Q E D L L V

L W G I H H P N D A A E Q T R L Y Q N P T T Y I S V G T S T L N Q R L V P K

I A T R S K V N G Q S G R M E F F W T I L K P N D A I N F E S N G N F I A P

E Y A Y K I V K K G D S A I M K S E L E Y G N C N T K C Q T P M G A I N S S

M P F H N I H P L T I G E C P K Y V K S N R L V L A T G L R N S P Q R E R R

R K K R G L F G A I A G F I E G G W Q G M V D G W Y G Y H H S N E Q G S G Y

A A D K E S T Q K A I D G V T N K V N S I I D K M N T Q F E A V G R E F N N

L E R R I E N L N K K M E D G F L D V W T Y N A E L L V L M E N E R T L D F

H D S N V K N L Y D K V R L Q L R D N A K E L G N C F E F Y H K C D N E C

M E S V R N G T Y D Y P Q Y S E E A R L K R E E I S G V K L E S I G I Y Q I

Q H S G G R S S L E G P R F E Q K L I S E E D L N M H T G H H H H H H

SEQ ID NO: 115

```
gaggtgcagc tggtggagtc tggggctgag gtgaagaagc ctgggtcctc ggtgaaagtc    60
tcttgcaagg cttctggagg ccccttccgc agctatgcta tcagctgggt gcgacaggcc   120
cctggacaag ggcctgagtg gatgggaggg atcatccta ttttggtac aacaaaatac   180
gcaccgaagt tccagggcag agtcacgatt accgcggacg atttcgcggg cacagtttac   240
atggagctga gcagcctgcg atctgaggac acggccatgt actactgtgc gaaacatatg   300
gggtaccagg tgcgcgaaac tatggacgtc tggggcaaag gaccacggt caccgtctcg   360
agcggtacgg gcggttcagg cggaaccggc agcggcactg gcgggtcgac gtcctatgtg   420
ctgactcagc cacccctcagc gtctgggacc cccgggcaga gggtcaccat ctcttgttct   480
ggaagcacgt tcaacatcgg aagtaatgct gtagactggt accggcagct cccaggaacg   540
gcccccaaac tcctcatcta tagtaataat cagcggccct cagggggtccc tgaccgattc   600
tctggctcca ggtctggcac ctcagcctcc ctggccatca gtgggctcca gtctgaggat   660
gaggctgatt attactgtgc agcatgggat gacatcctga atgttccggt attcggcgga   720
gggaccaagc tgaccgtcct aggt                                          744
```

SEQ ID NO: 116

E V Q L V E S G A E V K K P G S S V K V S C K A S G G P F R S Y A I S W V R

Q A P G Q G P E W M G G I I P I F G T T K Y A P K F Q G R V T I T A D D F A

G T V Y M E L S S L R S E D T A M Y Y C A K H M G Y Q V R E T M D V W G K G

T T V T V S S G T G G S G G T G S G T G G S T S Y V L T Q P P S A S G T P G

Q R V T I S C S G S T F N I G S N A V D W Y R Q L P G T A P K L L I Y S N N

Q R P S G V P D R F S G S R S G T S A S L A I S G L Q S E D E A D Y Y C A A

W D D I L N V P V F G G G T K L T V L G

SEQ ID NO: 117

```
caggtccagc tggtgcagtc tggggctgag gtgaagaagc ctgggtcctc ggtgaaagtc    60
tcttgcaagg cttctggagg ccccttccgc agctatgcta tcagctgggt gcgacaggcc   120
cctggacaag ggcctgagtg gatgggaggg atcatccta ttttggtac aacaaaatac   180
gcaccgaagt tccagggcag agtcacgatt accgcggacg atttcgcggg cacagtttac   240
atggagctga gcagcctgcg atctgaggac acggccatgt actactgtgc gaaacatatg   300
gggtaccagg tgcgcgaaac tatggacgtc tggggcaaag gaccacggt caccgtctcg   360
agcggtacgg gcggttcagg cggaaccggc agcggcactg gcgggtcgac gcagtctgcc   420
```

```
ctgactcagc ctgccgccgt gtctgggtct cctggacagt cgatcaccat ctcctgcact       480
ggaaccagca gtgacgttgg tggttataac tatgtctcct ggtaccaaca gcacccaggc       540
aaagccccca aactcatgat ttatgaggtc agtaatcggc cctcaggggt ttctaatcgc       600
ttctctggct ccaagtctgg caacacggcc tccctgacca tctctgggct ccaggctgag       660
gacgaggctg attattactg cagctcatat acaagcagca gcacttatgt cttcggaact       720
gggaccaagg tcaccgtcct aggt                                              744
```
                                                              SEQ ID NO: 118
```
Q V Q L V Q S G A E V K K P G S S V K V S C K A S G G P F R S Y A I S W V R

Q A P G Q G P E W M G G I I P I F G T T K Y A P K F Q G R V T I T A D D F A

G T V Y M E L S S L R S E D T A M Y Y C A K H M G Y Q V R E T M D V W G K G

T T V T V S S G T G G S G G T G S G T G G S T Q S A L T Q P A A V S G S P G

Q S I T I S C T G T S S D V G G Y N Y V S W Y Q Q H P G K A P K L M I Y E V

S N R P S G V S N R F S G S K S G N T A S L T I S G L Q A E D E A D Y Y C S

S Y T S S S T Y V F G T G T K V T V L G
```
                                                              SEQ ID NO: 119
```
gaggtgcagc tggtggagtc tggggctgag gtgaagaagc ctgggtcctc ggtgaaagtc        60
tcttgcaagg cttctggagg ccccttccgc agctatgcta tcagctgggt gcgacaggcc       120
cctggacaag gcctgagtg gatgggaggg atcatcccta tttttggtac aacaaaatac       180
gcaccgaagt tccagggcag agtcacgatt accgcggacg atttcgcggg cacagtttac       240
atggagctga gcagcctgcg atctgaggac acggccatgt actactgtgc gaaacatatg       300
gggtaccagg tgcgcgaaac tatggacgtc tggggcaaag gaccacggt caccgtctcg       360 agcggtacgg gcggttcagg cggaaccggc agcggcactg gcgggtcgac gtcctatgtg       420
ctgactcagc caccctcagt ctctgggacc ccgggcaga gggtcaccat ctcttgctct       480
ggaagccgct ccaacgtcgg agataattct gtatattggt atcaacacgt cccagaaatg       540 gccccccaaac tcctcgtcta taagaatact caacggccct caggagtccc tgcccggttt       600
tccggctcca gtctggcac ttcagcctcc ctggccatca ttggcctcca gtccggcgat       660
gaggctgatt attattgtgt ggcatgggat gacagcgtag atggctatgt cttcggatct       720
gggaccaagg tcaccgtcct aggt                                              744
```
                                                              SEQ ID NO: 120
```
E V Q L V E S G A E V K K P G S S V K V S C K A S G G P F R S Y A I S W V R

Q A P G Q G P E W M G G I I P I F G T T K Y A P K F Q G R V T I T A D D F A

G T V Y M E L S S L R S E D T A M Y Y C A K H M G Y Q V R E T M D V W G K G

T T V T V S S G T G G S G G T G S G T G G S T S Y V L T Q P P S V S G T P G

Q R V T I S C S G S R S N V G D N S V Y W Y Q H V P E M A P K L L V Y K N T

Q R P S G V P A R F S G S K S G T S A S L A I I G L Q S G D E A D Y Y C V A

W D D S V D G Y V F G S G T K V T V L G
```
                                                              SEQ ID NO: 121
```
gaggtgcagc tggtggagtc tggggctgag gtgaagaagc ctgggtcctc ggtgaaagtc        60
tcttgcaagg cttctggagg ccccttccgc agctatgcta tcagctgggt gcgacaggcc       120
cctggacaag gcctgagtg gatgggaggg atcatcccta tttttggtac aacaaaatac       180
gcaccgaagt tccagggcag agtcacgatt accgcggacg atttcgcggg cacagtttac       240
atggagctga gcagcctgcg atctgaggac acggccatgt actactgtgc gaaacatatg       300
gggtaccagg tgcgcgaaac tatggacgtc tggggcaaag gaccacggt caccgtctcg       360
```

```
agcggtacgg gcggttcagg cggaaccggc agcggcactg gcgggtcgac gcagtctgtg      420
ttgacgcagc cgccctcagt gtctgcggcc caggacaga aggtcaccat ctcctgctct        480
ggaagcagct ccaacattgg gaatgattat gtatcctggt accagcagct cccaggaaca      540
gcccccaaac tcctcattta tgacaataat aagcgaccct cagggattcc tgaccgattc      600
tctggctcca agtctggcac gtcagccacc ctgggcatca ccggactcca gactggggac      660
gaggccaact attactgcgc aacatgggat cgccgcccga ctgcttatgt tgtcttcggc      720
ggagggacca agctgaccgt cctaggt                                           747
```

```
                                                                SEQ ID NO: 122
E V Q L V E S G A E V K K P G S S V K V S C K A S G G P F R S Y A I S W V R

Q A P G Q G P E W M G G I I P I F G T T K Y A P K F Q G R V T I T A D D F A

G T V Y M E L S S L R S E D T A M Y Y C A K H M G Y Q V R E T M D V W G K G

T T V T V S S G T G G S G G T G S G T G G S T Q S V L T Q P P S V S A A P G

Q K V T I S C S G S S S N I G N D Y V S W Y Q Q L P G T A P K L L I Y D N N

K R P S G I P D R F S G S K S G T S A T L G I T G L Q T G D E A N Y Y C A T

W D R R P T A Y V V F G G G T K L T V L G
```

```
                                                                SEQ ID NO: 123
caggtacagc tgcagcagtc aggggctgag gtgaagaagc ctgggtcctc ggtgaaggtc       60
tcctgcaagg tttccggagt cattttcagc ggcagtgcga tcagctgggt gcgacaggcc      120
cctggacaag gccttgagtg gatgggaggg atcagccctc tctttggcac aacaaattac      180
gcacaaaagt tccagggcag agtcacgatt accgcggacc aatccacgaa cacaacctac      240
atggaggtga acagcctgag atatgaggac acggccgtgt atttctgtgc gcgaggtcca      300
aaatattaca gtgagtacat ggacgtctgg ggcaaaggga ccacggtcac cgtctcgagc      360
ggtacgggcg gttcaggcgg aaccggcagc ggcactggcg ggtcgacgga catccagatg      420
acccagtctc catcctccct gtctgcatct gtaggagaca gagtcaccat cacttgccgg      480
gcgagtcagg gcattagcag ttatttagcc tggtatcagc agaagccagg aaagttcct      540 acactcctga tctatgatgc atccactttg cgatcagggg tcccatctcg cttcagtggc      600
agtggatctg cgacagattt cactctcacc atcagcagcc tgcagcctga agatgttgca      660
acttattact gtcaaaggta taacagtgcc cccccgatca ccttcggcca agggacacga      720
ctggagatta aacgt                                                       735
```

```
                                                                SEQ ID NO: 124
Q V Q L Q Q S G A E V K K P G S S V K V S C K V S G V I F S G S A I S W V R

Q A P G Q G L E W M G G I S P L F G T T N Y A Q K F Q G R V T I T A D Q S T

N T T Y M E V N S L R Y E D T A V Y F C A R G P K Y Y S E Y M D V W G K G T

T V T V S S G T G G S G G T G S G T G G S T D I Q M T Q S P S S L S A S V G

D R V T I T C R A S Q G I S S Y L A W Y Q Q K P G K V P T L L I Y D A S T L

R S G V P S R F S G S G S A T D F T L T I S S L Q P E D V A T Y Y C Q R Y N

S A P P I T F G Q G T R L E I K R
```

```
                                                                SEQ ID NO: 125
caggtccagc tggtacagtc tggggctgag gtgaagaagc ctgggtcctc ggtgaaggtc       60
tcctgcaagg cttctggagg caccttcagt agttatgcta tcagctgggt gcgacaggcc      120
cctggacaag gccttgagtg gatgggagga atcatgggta tgtttggcac aactaactac      180
gcacagaagt tccagggcag agtcacgatt accgcggacg aattcacgag cgcagcctac      240
atggagctga ggagcctgag atctgaggac acggccgtct actactgtgc gaggtctagt      300
```

```
ggttattacc ccgaatactt ccaggactgg ggccagggca ccctggtcac cgtctcgagc      360
ggtacgggcg gttcaggcgg aaccggcagc ggcactggcg gtcgacgca gtctgtgctg       420 actcagccac cctcagagtc cgtgtcccca ggacagacag ccagcgtcac ctgctctgga      480
cataaattgg gggataaata tgtttcgtgg tatcagcaga agccaggcca gtcccctgta      540
ttactcatct atcaagataa caggcggccc tcagggatcc ctgagcgatt cataggctcc      600
aactctggga acacagccac tctgaccatc agcgggaccc aggctctgga tgaggctgac      660
tattactgtc aggcgtggga cagcagcact gcggttttcg gcggagggac caagctgacc      720
gtcctaggt                                                              729
```
                                                                        SEQ ID NO: 126

Q V Q L V Q S G A E V K K P G S S V K V S C K A S G G T F S S Y A I S W V R

Q A P G Q G L E W M G G I M G M F G T T N Y A Q K F Q G R V T I T A D E F T

S A A Y M E L R S L R S E D T A V Y Y C A R S S G Y Y P E Y F Q D W G Q G T

L V T V S S G T G G S G G T G S G T G G S T Q S V L T Q P P S E S V S P G Q

T A S V T C S G H K L G D K Y V S W Y Q Q K P G Q S P V L L I Y Q D N R R P

S G I P E R F I G S N S G N T A T L T I S G T Q A L D E A D Y Y C Q A W D S

S T A V F G G G T K L T V L G

```
                                                                        SEQ ID NO: 127
caggtccagc tggtgcagtc tgggggaggc ctggtcaagc ctgggggtc cctgagactc        60 tcctgtgcag cctctggatt caccttcagt agctatagca tgaactgggt ccgccaggct      120
ccagggaagg gctgagtg gtctcatcc attagtagta gtagtagtta catatactac         180
gtagactcag tgaagggccg attcaccatc tccagagaca acgccaagaa ctcactgtat      240
ctgcaaatga acagcctgag agccgaggac acggctgtgt attactgtgc gagaggtggt     300
gggagctacg gggcctacga aggctttgac tactggggcc agggcaccct ggtcaccgtc      360
tcgagcggta cgggcggttc aggcggaacc ggcagcggca ctggcgggtc gacggaaatt     420
gtgctgactc agtctccagg caccctgtct ttgtctccag gggaaagagc caccctctcc     480
tgcagggcca gtcagcgtgt tagcagctac ttagcctggt accaacagaa acctggccag    540
gctcccaggc tcctcatcta tggtgcatcc accagggccg ctggcatccc agacaggttc    600
agtggcagtg ggtctgggac agacttcact ctcaccatca gcagactgga gcctgaagat    660
tctgcagtgt attactgtca gcagtatggt aggacaccgc tcactttcgg cggagggacc     720
aaggtggaga tcaaacgt                                                    738
```
                                                                        SEQ ID NO: 128

Q V Q L V Q S G G G L V K P G G S L R L S C A A S G F T F S S Y S M N W V R

Q A P G K G L E W V S S I S S S S S Y I Y Y V D S V K G R F T I S R D N A K

N S L Y L Q M N S L R A E D T A V Y Y C A R G G G S Y G A Y E G F D Y W G Q

G T L V T V S S G T G G S G G T G S G T G G S T E I V L T Q S P G T L S L

P G E R A T L S C R A S Q R V S S Y L A W Y Q Q K P G Q A P R L L I Y G A S

T R A A G I P D R F S G S G S G T D F T L T I S R L E P E D S A V Y Y C Q Q

Y G R T P L T F G G G T K V E I K R

```
                                                                        SEQ ID NO: 129
gaggtgcagc tggtggagtc tgggctgag gtgaagaagc ctgggtcctc ggtgaaagtc         60
tcttgcaagg cttctggagg ccccttccgc agctatgcta tcagctgggt gcgacaggcc      120
cctggacaag gcctgagtg gatgggaggg atcatcccta ttttggtac aacaaaatac       180 gcaccgaagt tccagggcag agtcacgatt accgcggacg atttcgcggg cacagtttac      240
```

-continued

```
atggagctga gcagcctgcg atctgaggac acggccatgt actactgtgc gaaacatatg        300
gggtaccagg tgcgcgaaac tatggacgtc tggggcaaag gaccacggt caccgtctcg         360 agcggtacgg gcggttcagg cggaaccggc agcggcactg gcgggtcgac gtcctatgtg        420
ctgactcagc caccctcggt gtcagtggcc caggacaga cggccaggat tacctgtggg         480
ggaaacaaca ttggaagtaa aagtgtgcac tggtaccagc agaagccagg ccaggcccct        540
gtgctggtcg tctatgatga tagcgaccgg ccctcaggga tccctgagcg attctctggc       600
tccaactctg gaacacggc caccctgacc atcagcaggg tcgaagccgg ggatgaggcc        660
gactattact gtcaggtgtg ggatagtagt agtgatcatg ctgtgttcgg aggaggcacc       720
cagctgaccg tcctcggt                                                      738
```

SEQ ID NO: 130

E V Q L V E S G A E V K K P G S S V K V S C K A S G G P F R S Y A I S W V R

Q A P G Q G P E W M G G I I P I F G T T K Y A P K F Q G R V T I T A D D F A

G T V Y M E L S S L R S E D T A M Y Y C A K H M G Y Q V R E T M D V W G K G

T T V T V S S G T G G S G G T G S G T G G S T S Y V L T Q P P S V S V A P G

Q T A R I T C G G N N I G S K S V H W Y Q Q K P G Q A P V L V V Y D D S D R

P S G I P E R F S G S N S G N T A T L T I S R V E A G D E A D Y Y C Q V W D

S S S D H A V F G G G T Q L T V L G

SEQ ID NO: 131

```
gaggtgcagc tggtggagtc tggggctgag gtgaagaagc ctgggtcctc ggtgaaagtc        60
tcttgcaagg cttctggagg ccccttccgc agctatgcta tcagctgggt gcgacaggcc       120
cctggacaag ggcctgagtg gatgggaggg atcatcccta tttttggtac aacaaaatac       180
gcaccgaagt tccagggcag agtcacgatt accgcggacg atttcgcggg cacagtttac       240
atggagctga gcagcctgcg atctgaggac acggccatgt actactgtgc gaaacatatg       300
gggtaccagg tgcgcgaaac tatggacgtc tggggcaaag gaccacggt caccgtctcg         360 agcggtacgg gcggttcagg cggaaccggc agcggcactg gcgggtcgac gtcctatgtg        420
ctgactcagc caccctcagc gtctgggacc cccgggcaga gggtcaccat ctcttgttct       480
ggaagcagct ccaacatcgg aagtaattat gtatactggt accagcagct cccaggcacg      540
gcccccaaac tcctcatcta tagggatggt cagcggccct caggggtccc tgaccgattc       600
tctggctcca agtctggcac ctcagcctcc ctggccatca gtggactccg gtccgatgat      660
gaggctgatt attactgtgc aacatgggat gacaacctga gtggtccagt attcggcgga       720
gggaccaagc tgaccgtcct aggt                                              744
```

SEQ ID NO: 132

E V Q L V E S G A E V K K P G S S V K V S C K A S G G P F R S Y A I S W V R

Q A P G Q G P E W M G G I I P I F G T T K Y A P K F Q G R V T I T A D D F A

G T V Y M E L S S L R S E D T A M Y Y C A K H M G Y Q V R E T M D V W G K G

T T V T V S S G T G G S G G T G S G T G G S T S Y V L T Q P P S A S G T P G

Q R V T I S C S G S S S N I G S N Y V Y W Y Q Q L P G T A P K L L I Y R D G

Q R P S G V P D R F S G S K S G T S A S L A I S G L R S D D E A D Y Y C A T

W D D N L S G P V F G G G T K L T V L G

SEQ ID NO: 133

```
gaggtgcagc tggtggagtc tggggctgag gtgaagaagc cagggtcctc ggtgaaggtc        60
tcctgtaagg cctctggagg caccttctcc agctatggta tcagctgggt gcgacaggcc      120
cctggacaag ggcttgagtg gatgggagac atcatcggta tgtttggttc aacaaactac      180
```

```
gcacagaact tccagggcag actcacgatt accgcggacg aatccacgag cacagcctac      240
atggagctga gcagcctgag atctgaggac acggccgtgt attactgtgc gagaagtagt      300
ggttattacc ctgcatacct cccccactgg ggccagggca ccttggtcac cgtctcgagc      360
ggtacgggcg ttcaggcgg aaccggcagc ggcactggcg ggtcgacgga aattgtgttg       420
acccagtctc caggcaccct gtctttgtct ccaggggaaa gagccaccct ctcctgcagg      480
gccagtcaga gtgttagcag cagctactta gcctggtacc agcagaaacc tggccaggct      540
cccaggctcc tcatctatgg tgcatccagc agggccactg gcatcccaga caggttcagt      600
ggcagtgggt ctgggacaga cttcactctc accatcagca gactggagcc tgaagatttt      660
gcagtgtatt actgtcagca gtatggtagc tcacccagaa ctttcggcgg agggaccaag      720
gtggagatca aacgt                                                       735
```
                                                                     SEQ ID NO: 134
```
E V Q L V E S G A E V K K P G S S V K V S C K A S G G T F S S Y G I S W V R

Q A P G Q G L E W M G D I I G M F G S T N Y A Q N F Q G R L T I T A D E S T

S T A Y M E L S S L R S E D T A V Y Y C A R S S G Y Y P A Y L P H W G Q G T

L V T V S S G T G G S G G T G S G T G G S T E I V L T Q S P G T L S L S P G

E R A T L S C R A S Q S V S S S Y L A W Y Q Q K P G Q A P R L L I Y G A S S

R A T G I P D R F S G S G S G T D F T L T I S R L E P E D F A V Y Y C Q Q Y

G S S P R T F G G G T K V E I K R
```
                                                                     SEQ ID NO: 135
```
gaggtgcagc tggtggagtc tggggctgag gtgaagaagc cggggtcctc ggtgaaggtc       60
tcctgcaagg cttctggagg caccttcagc ttctattcta tgagctgggt gcgacaggcc      120
cctggacaag gacttgagtg gatgggaggg atcatcccta tgtttggtac aacaaactac      180
gcacagaagt tccagggcag agtcacgatt accgcggtcg aatccacgag cacagcctac      240
atggaggtga gcagcctgag atctgaggac acggccgttt attactgtgc gagaggtgat      300
aagggtatct actactacta catggacgtc tggggcaaag gaccacggt caccgtctcg       360 agcggtacgg gcggttcagg cggaaccggc agcggcactg gcgggtcgac gcagtctgcc      420
ctgactcagc ctgcctccgt gtctgggtct cctggacagt cgatcaccat ctcctgcact      480
ggaaccagca gtgacgttgg tggttataac tatgtctcct ggtaccaaca gcacccaggc      540
aaagccccca aactcatgat ttatgaggtc agtaatcggc cctcaggggt ttctaatcgc      600
ttctctggct ccaagtctgg caacacggcc tccctgacca tctctgggct ccaggctgag      660
gacgaggctg attattactg cagctcatat acaagcagca gcactcttgt cttcggaact      720
gggaccaagg tcaccgtcct aggt                                             744
```
                                                                     SEQ ID NO: 136
```
E V Q L V E S G A E V K K P G S S V K V S C K A S G G T F S F Y S M S W V R

Q A P G Q G L E W M G G I I P M F G T T N Y A Q K F Q G R V T I T A V E S T

S T A Y M E V S S L R S E D T A V Y Y C A R G D K G I Y Y Y Y M D V W G K G

T T V T V S S G T G G S G G T G S G T G G S T Q S A L T Q P A S V S G S P G

Q S I T I S C T G T S S D V G G Y N Y V S W Y Q Q H P G K A P K L M I Y E V

S N R P S G V S N R F S G S K S G N T A S L T I S G L Q A E D E A D Y Y C S

S Y T S S S T L V F G T G T K V T V L G
```
                                                                     SEQ ID NO: 137
```
gaggtgcagc tggtggagtc tggggctgag gtgaagaagc ctgggtcctc ggtgaaggtc       60
tcctgcaagg cttctggagg caccttcagc agctatgcta tcagctgggt gcgacaggcc      120
```

```
cctggacaag ggcttgagtg gatgggaggg atcatcggta tgttcggtac agcaaactac      180
gcacagaagt tccagggcag agtcacgatt accgcggacg aatttacgag cacagcctac      240
atggagctga gcagcctgag atctgaggac acggccgtgt attactgtgc gagaggaaat      300
tattactatg agagtagtct cgactactgg ggccagggaa ccctggtcac cgtctcgagc      360
ggtacgggcg gttcaggcgg aaccggcagc ggcactggcg gtcgacgca gtctgtcgtg       420 acgcagccgc cctcggtgtc agtggcccca ggacagacgg ccaggattac ctgtggggga      480
aacaacattg gaagtaaaag tgtgcactgg taccagcaga agccaggcca ggcccctgtg      540
ctggtcgtct atgatgatag cgaccggccc tcagggatcc ctgagcgatt ctctggctcc      600
aactctggga acacggccac cctgaccatc agcagggtcg aagccgggga tgaggccgac      660
tattactgtc aggtgtggga tagtagtagt gatcattatg tcttcggaac tgggaccaag      720
gtcaccgtcc taggt                                                      735
```

SEQ ID NO: 138
E V Q L V E S G A E V K K P G S S V K V S C K A S G G T F S S Y A I S W V R

Q A P G Q G L E W M G G I I G M F G T A N Y A Q K F Q G R V T I T A D E F T

S T A Y M E L S S L R S E D T A V Y Y C A R G N Y Y Y E S S L D Y W G Q G T

L V T V S S G T G G S G G T G S G T G G S T Q S V V T Q P P S V S V A P G Q

T A R I T C G G N N I G S K S V H W Y Q Q K P G Q A P V L V V Y D D S D R P

S G I P E R F S G S N S G N T A T L T I S R V E A G D E A D Y Y C Q V W D S

S S D H Y V F G T G T K V T V L G

SEQ ID NO: 139
```
caggtgcagc tggtgcagtc tggggctgag gtgaagaagc ctgggtcctc ggtgagagtc       60
tcctgcaagg cttctggaag catcttcaga aactatgcta tgagctgggt gcgacaggcc     120
cctggacaag ggcttgagtg gatgggaggg atcatcgcta tttttgggac accaaagtac     180
gcacagaagt tccagggcag agtcacgatt accgcggacg aatcgacgag cactgtctac     240
atggaactga gcggactgag atctgaggac acggccatgt attactgtgc gaggattccc     300
cactataatt ttggttcggg gagttatttc gactactggg gccagggaac cctggtcacc     360
gtctcgagcg gtacgggcgg ttcaggcgga accggcagcg gcactggcgg tcgacgact     420 gtgttgacac agccgccctc agtgtctggg gccccagggc agagggtcac catctcctgc     480
actgggagca gctccaacat cggggcaggt tatgatgtac actggtacca gcagcttcca    540
ggaacagccc ccaaactcct catctatggt aacagcaatc ggccctcagg ggtccctgac    600
cgattctctg gctccaagtc tggcacgtca gccaccctgg gcatcaccgg actccagact   660
ggggacgagg ccgattatta ctgcggaaca tgggatagca gcctgagtgc ttatgtcttc   720
ggaactggga ccaaggtcac cgtcctaggt                                   750
```

SEQ ID NO: 140
Q V Q L V Q S G A E V K K P G S S V R V S C K A S G S I F R N Y A M S W V R

Q A P G Q G L E W M G G I I A I F G T P K Y A Q K F Q G R V T I T A D E S T

S T V Y M E L S G L R S E D T A M Y Y C A R I P H Y N F G S G S Y F D Y W G

Q G T L V T V S S G T G G S G G T G S G T G G S T T V L T Q P P S V S G A P

G Q R V T I S C T G S S S N I G A G Y D V H W Y Q Q L P G T A P K L L I Y G

N S N R P S G V P D R F S G S K S G T S A T L G I T G L Q T G D E A D Y Y C

G T W D S S L S A Y V F G T G T K V T V L G

-continued

SEQ ID NO: 141

```
tcgacggatc gggagatctc ccgatcccct atggtgcact ctcagtacaa tctgctctga    60
tgccgcatag ttaagccagt atctgctccc tgcttgtgtg ttggaggtcg ctgagtagtg   120
cgcgagcaaa atttaagcta caacaaggca aggcttgacc gacaattgca tgaagaatct   180
gcttagggtt aggcgttttg cgctgcttcg ctaggtggtc aatattggcc attagccata   240
ttattcattg gttatatagc ataaatcaat attggctatt ggccattgca tacgttgtat   300
ccatatcata atatgtacat ttatattggc tcatgtccaa cattaccgcc atgttgacat   360
tgattattga ctagttatta atagtaatca attacggggt cattagttca tagcccatat   420
atggagttcc gcgttacata acttacggta aatggcccgc ctggctgacc gcccaacgac   480
ccccgcccat tgacgtcaat aatgacgtat gttcccatag taacgccaat agggactttc   540
cattgacgtc aatgggtgga gtatttacgg taaactgccc acttggcagt acatcaagtg   600
tatcatatgc caagtacgcc ccctattgac gtcaatgacg gtaaatggcc cgcctggcat   660
tatgcccagt acatgacctt atgggacttt cctacttggc agtacatcta cgtattagtc   720
atcgctatta ccatggtgat gcggttttgg cagtacatca atgggcgtgg atagcggttt   780
gactcacggg gatttccaag tctccacccc attgacgtca atgggagttt gttttggcac   840
caaaatcaac gggactttcc aaaatgtcgt aacaactccg ccccattgac gcaaatgggc   900
ggtaggcgtg tacggtggga ggtctatata agcagagctc gtttagtgaa ccgtcagatc   960
gcctggagac gccatccacg ctgttttgac ctccatagaa gacaccggga ccgatccagc  1020
ctccgcggcc gggaacggtg cattggaagc tggcctggat atcctgactc tcttaggtag  1080
ccttgcagaa gttggtcgtg aggcactggg caggtaagta tcaaggttac aagacaggtt  1140
taaggagatc aatagaaact gggcttgtcg agacagagaa gactcttgcg tttctgatag  1200
gcacctattg gtcttactga catccacttt gcctttctct ccacaggtgt ccactcccag  1260
ttcaattaca gctcgccacc atgggatgga gctgtatcat cctcttcttg gtactgctgc  1320
tgggcccagcc ggccagtgac cttgaccggt gcaccacttt tgatgatgtt caagctccta  1380
attacactca acatacttca tctatgaggg gggtttacta tcctgatgaa atttttagat  1440
cggacactct ttatttaact caggatttat ttcttccatt ttattctaat gttacagggt  1500
ttcatactat taatcatacg tttggcaacc ctgtcatacc ttttaaggat ggtatttatt  1560
ttgctgccac agagaaatca aatgttgtcc gtggttgggt ttttggttct accatgaaca  1620
acaagtcaca gtcggtgatt attattaaca attctactaa tgttgttata cgagcatgta  1680
actttgaatt gtgtgacaac cctttctttg ctgtttctaa acccatgggt acacagacac  1740
atactatgat attcgataat gcatttaatt gcactttcga gtacatatct gatgccttt   1800
cgcttgatgt ttcagaaaag tcaggtaatt ttaaacactt acgagagttt gtgtttaaaa  1860
ataaagatgg gttctctat gtttataagg ctatcaacc tatagatgta gttcgtgatc    1920
taccttctgg ttttaacact tgaaaccta tttttaagtt gcctcttggt attaacatta   1980
caaatttag agccattctt acagccttt cacctgctca agacatttgg ggcacgtcag    2040
ctgcagccta ttttgttggc tatttaaagc caactacatt tatgctcaag tatgatgaaa  2100
atggtacaat cacagatgct gttgattgtt ctcaaaatcc acttgctgaa ctcaaatgct  2160
ctgttaagag ctttgagatt gacaaaggaa tttaccagac ctctaatttc agggttgttc  2220
cctcaggaga tgttgtgaga ttccctaata ttacaaactt gtgtcctttt ggagaggttt  2280
taatgctac taaattccct tctgtctatg catgggagag aaaaaaaatt tctaattgtg   2340
ttgctgatta ctctgtgctc tacaactcaa catttttttc aacctttaag tgctatggcg  2400
```

-continued

```
tttctgccac taagttgaat gatctttgct tctccaatgt ctatgcagat tcttttgtag    2460
tcaagggaga tgatgtaaga caaatagcgc caggacaaac tggtgttatt gctgattata    2520
attataaatt gccagatgat ttcatgggtt gtgtccttgc ttggaatact aggaacattg    2580
atgctacttc aactggtaat tataattata aatataggta tcttagacat ggcaagctta    2640 ggcccttttga gagagacata tctaatgtgc ctttctcccc tgatggcaaa ccttgcaccc    2700
cacctgctct taattgttat tggccattaa atgattatgg tttttacacc actactggca    2760
ttggctacca accttacaga gttgtagtac tttcttttga acttttaaat gcaccggcca    2820
cggtttgtgg accaaaatta tccactgacc ttattaagaa ccagtgtgtc aatttttaatt    2880 ttaatggact cactggtact ggtgtgttaa ctccttcttc aaagagattt caaccatttc    2940
aacaatttgg ccgtgatgtt tctgatttca ctgattccgt tcgagatcct aaaacatctg    3000
aaatattaga catttcacct tgctcttttg ggggtgtaag tgtaattaca cctggaacaa    3060
atgcttcatc tgaagttgct gttctatatc aagatgttaa ctgcactgat gtttctacag    3120
caattcatgc agatcaactc acaccagctt ggcgcatata ttctactgga aacaatgtat    3180
tccagactca ggcaggctgt cttataggag ctgagcatgt cgacacttct tatgagtgcg    3240
acattcctat tggagctggc atttgtgcta gttaccatac agtttcttta ttacgtagta    3300
ctagccaaaa atctattgtg gcttatacta tgtctttagg tgctgatagt tcaattgctt    3360
actctaataa caccattgct atacctacta acttttcaat tagcattact acagaagtaa    3420
tgcctgtttc tatggctaaa acctccgtag attgtaatat gtacatctgc ggagattcta    3480
ctgaatgtgc taatttgctt ctccaatatg gtagcttttg cacacaacta aatcgtgcac    3540
tctcaggtat tgctgctgaa caggatcgca acacacgtga agtgttcgct caagtcaaac    3600
aaatgtacaa acccccaact ttgaaatatt ttggtggttt taatttttca caatattac    3660 ctgaccctct aaagccaact aagaggtctt ttattgagga cttgctcttt aataaggtga    3720
cactcgctga tgctggcttc atgaagcaat atggcgaatg cctaggtgat attaatgcta    3780
gagatctcat ttgtgcgcag aagttcaatg gacttacagt gttgccacct ctgctcactg    3840
atgatatgat tgctgcctac actgctgctc tagttagtgg tactgccact gctggatgga    3900
catttggtgc tggcgctgct cttcaaatac cttttgctat gcaaatggca tataggttca    3960
atggcattgg agttacccaa atgttctctc atgagaacca aaaacaaatc gccaaccaat    4020
ttaacaaggc gattagtcaa attcaagaat cacttacaac aacatcaact gcattgggca    4080
agctgcaaga cgttgttaac cagaatgctc aagcattaaa cacacttgtt aaacaactta    4140
gctctaattt tggtgcaatt tcaagtgtgc taaatgatat cctttcgcga cttgataaag    4200
tcgaggcgga ggtacaaatt gacaggttaa ttacaggcag acttcaaagc cttcaaacct    4260
atgtaacaca caactaatc agggctgctg aaatcagggc ttctgctaat cttgctgcta    4320
ctaaaatgtc tgagtgtgtt cttggacaat caaaaagagt tgacttttgt ggaaagggct    4380
accaccttat gtccttccca caagcagccc cgcatggtgt tgtcttccta catgtcacgt    4440
atgtgccatc ccaggagagg aacttcacca cagcgccagc aatttgtcat gaaggcaaag    4500
catacttccc tcgtgaaggt gttttttgtgt taatggcac ttcttggttt attacacaga    4560
ggaacttctt ttctccacaa ataattacta cagacaatac atttgtctca ggaaattgtg    4620
atgtcgttat tggcatcatt aacaacacag tttatgatcc tctgcaacct gagcttgact    4680
cattcaaaga agagctggac aagtacttca aaaatcatac atcaccagat gttgattttg    4740
gcgacatttc aggcattaac gcttctgtcg tcaacattca aaaagaaatt gaccgcctca    4800
atgaggtcgc taaaaattta aatgaatcac tcattgacct tcaagaactg ggaaaatatg    4860
```

```
agcaatatat taaatggcct ctcgacgaac aaaaactcat ctcagaagag gatctgaatg    4920
ctgtgggcca ggacacgcag gaggtcatcg tggtgccaca ctccttgccc tttaaggtgg    4980
tggtgatctc agccatcctg gccctggtgg tgctcaccat catctccctt atcatcctca    5040
tcatgctttg gcagaagaag ccacgttagg cggccgctcg agtgctagca ccaagggccc    5100
cagcgtgttc ccctggcc ccagcagcaa gagcaccagc ggcggcacag ccgccctggg    5160
ctgcctggtg aaggactact ccccgagcc cgtgaccgtg agctggaaca gcggcgcctt    5220
gaccagcggc gtgcacacct tccccgccgt gctgcagagc agcggcctgt acagcctgag    5280
cagcgtggtg accgtgccca gcagcagcct gggcacccag acctacatct gcaacgtgaa    5340
ccacaagccc agcaacacca aggtggacaa acgcgtggag cccaagagct gcgacaagac    5400
ccacacctgc cccccctgcc ctgccccga gctgctgggc ggaccctccg tgttcctgtt    5460
cccccccaag cccaaggaca ccctcatgat cagccggacc cccgaggtga cctgcgtggt    5520
ggtggacgtg agccacgagg accccgaggt gaagttcaac tggtacgtgg acggcgtgga    5580
ggtgcacaac gccaagacca gcccgggga ggagcagtac aacagcacct accgggtggt    5640
gagcgtgctc accgtgctgc accaggactg gctgaacggc aaggagtaca agtgcaaggt    5700
gagcaacaag gccctgcctg cccccatcga aaagaccatc agcaaggcca agggccagcc    5760
ccgggagccc caggtgtaca ccctgccccc cagccgggag gagatgacca agaaccaggt    5820
gtccctcacc tgtctggtga agggcttcta ccccagcgac atcgccgtgg agtgggagag    5880
caacggccag cccgagaaca actacaagac caccccccct gtgctggaca gcgacggcag    5940
cttcttcctg tacagcaagc tcaccgtgga caagagccgg tggcagcagg gcaacgtgtt    6000
cagctgcagc gtgatgcacg aggccctgca caaccactac acccagaaga gcctgagcct    6060
gagccccggc aagtgataat ctagagggcc gtttaaacc cgctgatcag cctcgactgt    6120
gccttctagt tgccagccat ctgttgtttg cccctccccc gtgccttcct tgaccctgga    6180
aggtgccact cccactgtcc tttcctaata aaatgaggaa attgcatcgc attgtctgag    6240
taggtgtcat tctattctgg ggggtggggt ggggcaggac agcaagggg aggattggga    6300 agacaatagc aggcatgctg gggatgcggt gggctctatg gcttctgagg cggaaagaac    6360 cagctgggc tctaggggt atccccacgc gccctgtagc ggcgcattaa gcgcggcggg    6420
tgtggtggtt acgcgcagcg tgaccgctac acttgccagc gccctagcgc ccgctccttt    6480
cgctttcttc ccttcctttc tcgccacgtt cgccggcttt ccccgtcaag ctctaaatcg    6540
ggggctccct ttagggttcc gatttagtgc tttacggcac ctcgacccca aaaaacttga    6600
ttagggtgat ggttcacgta gtgggccatc gccctgatag acggtttttc gccctttgac    6660 gttgagtcc acgttcttta atagtggact cttgttccaa actggaacaa cactcaaccc    6720
tatctcggtc tattcttttg atttataagg gattttgccg atttcggcct attggttaaa    6780
aaatgagctg atttaacaaa aatttaacgc gaattaattc tgtggaatgt gtgtcagtta    6840
gggtgtggaa agtccccagg ctccccagca ggcagaagta tgcaaagcat gcatctcaat    6900
tagtcagcaa ccaggtgtgg aaagtcccca ggctccccag caggcagaag tatgcaaagc    6960
atgcatctca attagtcagc aaccatagtc ccgcccctaa ctccgcccat cccgcccta    7020 actccgccca gttccgccca ttctccgccc catggctgac taattttttt tatttatgca    7080
gaggccgagg ccgcctctgc ctctgagcta ttccagaagt agtgaggagg cttttttgga    7140
ggcctaggct tttgcaaaaa gctcccggga gcttgtatat ccattttcgg atctgatcaa    7200
gagacaggat gaggatcgtt tcgcatgatt gaacaagatg gattgcacgc aggttctccg    7260
gccgcttggg tggagaggct attcggctat gactgggcac aacagacaat cggctgctct    7320
```

-continued

```
gatgccgccg tgttccggct gtcagcgcag gggcgcccgg ttcttttgt caagaccgac    7380 ctgtccggtg ccctgaatga actgcaggac gaggcagcgc ggctatcgtg gctggccacg    7440
acgggcgttc cttgcgcagc tgtgctcgac gttgtcactg aagcgggaag ggactggctg    7500
ctattgggcg aagtgccggg gcaggatctc ctgtcatctc accttgctcc tgccgagaaa    7560
gtatccatca tggctgatgc aatgcggcgg ctgcatacgc ttgatccggc tacctgccca    7620
ttcgaccacc aagcgaaaca tcgcatcgag cgagcacgta ctcggatgga agccggtctt    7680
gtcgatcagg atgatctgga cgaagagcat caggggctcg cgccagccga actgttcgcc    7740
aggctcaagg cgcgcatgcc cgacggcgag gatctcgtcg tgacccatgg cgatgcctgc    7800
ttgccgaata tcatggtgga aaatggccgc ttttctggat tcatcgactg tggccggctg    7860
ggtgtggcgg accgctatca ggacatagcg ttggctaccc gtgatattgc tgaagagctt    7920
ggcggcgaat gggctgaccg cttcctcgtg ctttacggta tcgccgctcc cgattcgcag    7980
cgcatcgcct tctatcgcct tcttgacgag ttcttctgag cgggactctg gggttcgaaa    8040
tgaccgacca agcgacgccc aacctgccat cacgagattt cgattccacc gccgccttct    8100
atgaaaggtt gggcttcgga atcgttttcc gggacgccgg ctggatgatc ctccagcgcg    8160
gggatctcat gctggagttc ttcgcccacc ccaacttgtt tattgcagct tataatggtt    8220
acaaataaag caatagcatc acaaatttca caaataaagc atttttttca ctgcattcta    8280
gttgtggttt gtccaaactc atcaatgtat cttatcatgt ctgtataccg tcgacctcta    8340
gctagagctt ggcgtaatca tggtcatagc tgtttcctgt gtgaaattgt tatccgctca    8400
caattccaca acatacga gccggaagca taaagtgtaa agcctggggt gcctaatgag    8460
tgagctaact cacattaatt gcgttgcgct cactgcccgc tttccagtcg gaaacctgt    8520 cgtgccagct gcattaatga atcggccaac gcgcggggag aggcggtttg cgtattgggc    8580
gctcttccgc ttcctcgctc actgactcgc tgcgctcggt cgttcggctg cggcgagcgg    8640
tatcagctca ctcaaaggcg gtaatacggt tatccacaga atcaggggat aacgcaggaa    8700
agaacatgtg agcaaaaggc cagcaaaagg ccaggaaccg taaaaaggcc gcgttgctgg    8760
cgttttccca taggctccgc ccccctgacg agcatcacaa aaatcgacgc tcaagtcaga    8820
ggtggcgaaa cccgacagga ctataaagat accaggcgtt tcccctgga agctccctcg    8880 tgcgctctcc tgttccgacc ctgccgctta ccggatacct gtccgccttt ctcccttcgg    8940
gaagcgtggc gctttctcat agctcacgct gtaggtatct cagttcggtg taggtcgttc    9000
gctccaagct gggctgtgtg cacgaacccc ccgttcagcc cgaccgctgc gccttatccg    9060
gtaactatcg tcttgagtcc aacccggtaa gacacgactt atcgccactg gcagcagcca    9120
ctggtaacag gattagcaga gcgaggtatg taggcggtgc tacagagttc ttgaagtggt    9180
ggcctaacta cggctacact agaagaacag tatttggtat ctgcgctctg ctgaagccag    9240
ttaccttcgg aaaaagagtt ggtagctctt gatccggcaa acaaaccacc gctggtagcg    9300 gttttttgt ttgcaagcag cagattacgc gcagaaaaaa aggatctcaa gaagatcctt    9360 tgatctttc tacggggtct gacgctcagt ggaacgaaaa ctcacgttaa gggattttgg    9420
tcatgagatt atcaaaaagg atcttcacct agatcctttt aaattaaaaa tgaagtttta    9480
aatcaatcta agtatatat gagtaaactt ggtctgacag ttaccaatgc ttaatcagtg    9540
aggcacctat ctcagcgatc tgtctatttc gttcatccat agttgcctga ctccccgtcg    9600
tgtagataac tacgatacgg gagggcttac catctggccc cagtgctgca atgataccgc    9660
gagacccacg ctcaccggct ccagatttat cagcaataaa ccagccagcc ggaagggccg    9720
agcgcagaag tggtcctgca actttatccg cctccatcca gtctattaat tgttgccggg    9780
```

-continued

```
aagctagagt aagtagttcg ccagttaata gtttgcgcaa cgttgttgcc attgctacag      9840
gcatcgtggt gtcacgctcg tcgtttggta tggcttcatt cagctccggt tcccaacgat      9900
caaggcgagt tacatgatcc cccatgttgt gcaaaaaagc ggttagctcc ttcggtcctc      9960
cgatcgttgt cagaagtaag ttggccgcag tgttatcact catggttatg gcagcactgc     10020
ataattctct tactgtcatg ccatccgtaa gatgcttttc tgtgactggt gagtactcaa     10080
ccaagtcatt ctgagaatag tgtatgcggc gaccgagttg ctcttgcccg gcgtcaatac     10140
gggataatac cgcgccacat agcagaactt taaaagtgct catcattgga aaacgttctt     10200
cggggcgaaa actctcaagg atcttaccgc tgttgagatc cagttcgatg taacccactc     10260
gtgcacccaa ctgatcttca gcatctttta cttttaccag cgtttctggg tgagcaaaaa     10320
caggaaggca aaatgccgca aaaaagggaa taagggcgac acggaaatgt tgaatactca     10380
tactcttcct ttttcaatat tattgaagca tttatcaggg ttattgtctc atgagcggat     10440
acatatttga atgtatttag aaaaataaac aaatagggt tccgcgcaca tttccccgaa      10500
aagtgccacc tgacg                                                      10515

SEQ ID NO: 142
tcgacggatc gggagatctc ccgatcccct atggtgcact ctcagtacaa tctgctctga         60
tgccgcatag ttaagccagt atctgctccc tgcttgtgtg ttggaggtcg ctgagtagtg        120
cgcgagcaaa atttaagcta caacaaggca aggcttgacc gacaattgtt aattaacatg        180
aagaatctgc ttagggttag gcgttttgcg ctgcttcgct aggtggtcaa tattggccat        240
tagccatatt attcattggt tatatagcat aaatcaatat tggctattgg ccattgcata        300
cgttgtatcc atatcataat atgtacattt atattggctc atgtccaaca ttaccgccat        360
gttgacattg attattgact agttattaat agtaatcaat tacggggtca ttagttcata        420
gcccatatat ggagttccgc gttacataac ttacggtaaa tggcccgcct ggctgaccgc        480
ccaacgaccc ccgcccattg acgtcaataa tgacgtatgt tcccatagta acgccaatag        540
ggactttcca ttgacgtcaa tgggtggagt atttacggta aactgcccac ttggcagtac        600
atcaagtgta tcatatgcca agtacgcccc ctattgacgt caatgacggt aaatggcccg        660
cctggcatta tgcccagtac atgaccttat gggactttcc tacttggcag tacatctacg        720
tattagtcat cgctattacc atggtgatgc ggttttggca gtacatcaat gggcgtggat        780
agcggtttga ctcacgggga tttccaagtc tccaccccat tgacgtcaat gggagtttgt        840
tttggcacca aaatcaacgg gactttccaa aatgtcgtaa caactccgcc ccattgacgc        900
aaatgggcgg taggcgtgta cggtgggagg tctatataag cagagctcgt ttagtgaacc        960
gtcagatcgc ctggagacgc catccacgct gttttgacct ccatagaaga caccgggacc       1020
gatccagcct ccgcggccgg gaacggtgca ttggaatcga tgactctctt aggtagcctt       1080
gcagaagttg gtcgtgaggc actgggcagg taagtatcaa ggttacaaga caggtttaag       1140
gagatcaata gaaactgggc ttgtcgagac agagaagact cttgcgtttc tgataggcac       1200
ctattggtct tactgacatc cactttgcct ttctctccac aggtgtccac tcccagttca       1260
attacagctc gccaccatgc ggctgcccgc ccagctgctg gccttctca tgctgtgggt       1320 gcccgcctcg agatctatcg atgcatgcca tggtaccaag cttgccacca tgagcagcag       1380
ctcttggctg ctgctgagcc tggtggccgt gacagccgcc cagagcacca tcgaggagca       1440
ggccaagacc ttcctggaca gttcaacca cgaggccgag gacctgttct accagagcag       1500
cctggccagc tggaactaca acaccaacat caccgaggag aacgtgcaga acatgaacaa       1560
cgccggcgac aagtggagcg ccttcctgaa ggagcagagc acactggccc agatgtaccc       1620
```

-continued

```
cctgcaggag atccagaacc tgaccgtgaa gctgcagctg caggccctgc agcagaacgg   1680
cagcagcgtg ctgagcgagg acaagagcaa gcggctgaac accatcctga acaccatgtc   1740
caccatctac agcaccggca aagtgtgcaa ccccgacaac ccccaggagt gcctgctgct   1800
ggagcccggc ctgaacgaga tcatggccaa cagcctggac tacaacgagc ggctgtgggc   1860
ctgggagagc tggcggagcg aagtgggcaa gcagctgcgg cccctgtacg aggagtacgt   1920
ggtgctgaag aacgagatgg ccagggccaa ccactacgag gactacgcg actactggag    1980 aggcgactac gaagtgaacg gcgtggacgg ctacgactac agcagaggcc agctgatcga   2040
ggacgtggag cacaccttcg aggagatcaa gcctctgtac gagcacctgc acgcctacgt   2100
gcgggccaag ctgatgaacg cctaccccag ctacatcagc cccatcggct gcctgcccgc   2160
ccacctgctg ggcgacatgt ggggccggtt ctggaccaac ctgtacagcc tgaccgtgcc   2220
cttcggccag aagcccaaca tcgacgtgac cgacgccatg gtggaccagg cctgggacgc   2280
ccagcggatc ttcaaggagg ccgagaagtt cttcgtgagc gtgggcctgc caacatgac    2340 ccagggcttt tgggagaaca gcatgctgac cgaccccggc aatgtgcaga aggccgtgtg   2400
ccaccccacc gcctgggacc tgggcaaggg cgacttccgg atcctgatgt gcaccaaagt   2460
gaccatggac gacttcctga ccgcccacca cgagatgggc cacatccagt acgacatggc   2520
ctacgccgcc cagcccttcc tgctgcggaa cggcgccaac gagggctttc acgaggccgt   2580
gggcgagatc atgagcctga cgccgccac ccccaagcac ctgaagagca tcggcctgct    2640
gagccccgac ttccaggagg acaacgagac cgagatcaac ttcctgctga gcaggccct    2700 gaccatcgtg ggcaccctgc ccttcaccta catgctggaa agtggcggt ggatggtgtt     2760 taagggcgag atccccaagg accagtggat gaagaagtgg tgggagatga agcgggagat   2820
cgtgggcgtg gtggagcccg tgccccacga cgagacctac tgcgacccg ccagcctgtt    2880 ccacgtgagc aacgactact ccttcatccg gtactacacc cggaccctgt accagttcca   2940
gttccaggag gccctgtgcc aggccgccaa gcacgagggc cccctgcaca agtgcgacat   3000
cagcaacagc accgaggccg acagaaact gttcaacatg ctgcggctgg caagagcga    3060 gccctggacc ctggccctgg agaatgtggt gggcgccaag aacatgaatg tgcgcccct    3120 gctgaactac ttcgagcccc tgttcacctg gctgaaggac cagaacaaga acagcttcgt   3180
gggctggagc accgactgga gcccctacgc cgaccagagc atcaaagtgc ggatcagcct   3240
gaagagcgcc ctgggcgaca aggcctacga gtggaacgac aacgagatgt acctgttccg   3300
gagcagcgtg gcctatgcca tgcggcagta cttcctgaaa gtgaagaacc agatgatcct   3360
gttcggcgag gaggacgtga gagtggccaa cctgaagccc cggatcagct tcaacttctt   3420
cgtgaccgcc cccaagaacg tgagcgacat catcccccgg accgaagtgg agaaggccat   3480
ccggatgagc cggagccgga tcaacgacgc cttccggctg aacgacaact ccctggagtt   3540
cctgggcatc cagcccaccc tgggccctcc caaccagccc cccgtgagca tctggctgat   3600
cgtgtttggc gtggtgatgg gcgtgatcgt ggtgggaatc gtgatcctga tcttcaccgg   3660 catcccgggac cggaagaaga gaacaaggc ccggagcggc gagaacccct acgccagcat    3720
cgatatcagc aagggcgaga acaaccccgg cttccagaac accgacgacg tgcagaccag   3780
cttctgataa tctagaacga gctcgaattc gaagcttctg cagacgcgtc gacgtcatat   3840
ggatccgata tcgccgtggc ggccgcaccc agcgtgttca tcttcccccc ctccgacgag   3900
cagctgaaga gcggcaccgc cagcgtggtg tgcctgctga caacttcta cccccgggag   3960 gccaaggtgc agtggaaggt ggacaacgcc ctgcagagcg gcaacagcca ggagagcgtg   4020
accgagcagg acagcaagga ctccaccctac agcctgagca gcaccctcac cctgagcaag   4080
```

-continued

```
gccgactacg agaagcacaa ggtgtacgcc tgcgaggtga cccaccaggg cctgagcagc    4140
cccgtgacca agagcttcaa ccggggcgag tgttaataga cttaagttta aaccgctgat    4200
cagcctcgac tgtgccttct agttgccagc catctgttgt ttgcccctcc cccgtgcctt    4260
ccttgaccct ggaaggtgcc actcccactg tcctttccta ataaaatgag gaaattgcat    4320
cgcattgtct gagtaggtgt cattctattc tggggggtgg ggtggggcag gacagcaagg    4380
gggaggattg gaagacaat agcaggcatg ctggggatgc ggtgggctct atggcttctg     4440
aggcggaaag aaccagctgg ggctctaggg ggtatcccca cgcgcccgt agcggcgcat     4500 taagcgcggc gggtgtggtg gttacgcgca gcgtgaccgc tacacttgcc agcgccctag    4560
cgcccgctcc tttcgctttc ttcccttcct ttctcgccac gttcgccggc tttccccgtc    4620
aagctctaaa tcgggggctc cctttagggt tccgatttag tgctttacgg cacctcgacc    4680
ccaaaaaact tgattagggt gatggttcac gtagtgggcc atcgccctga tagacggttt    4740
ttcgcccttt gacgttggag tccacgttct ttaatagtgg actcttgttc caaactggaa    4800
caacactcaa ccctatctcg gtctattctt ttgatttata agggattttg gccatttcgg    4860
cctattggtt aaaaaatgag ctgatttaac aaaaatttaa cgcgaattaa ttctgtggaa    4920
tgtgtgtcag ttagggtgtg gaaagtcccc aggctcccca gcaggcagaa gtatgcaaag    4980
catgcatctc aattagtcag caaccaggtg tggaaagtcc ccaggctccc cagcaggcag    5040
aagtatgcaa agcatgcatc tcaattagtc agcaaccata gtcccgcccc taactccgcc    5100
catcccgccc ctaactccgc ccagttccgc ccattctccg cccatggct gactaatttt     5160 ttttatttat gcagaggccg aggccgcctc tgcctctgag ctattccaga agtagtgagg    5220 aggcttttt ggaggcctag gcttttgcaa aaagctcccg ggagcttgta tatccatttt     5280
cggatctgat cagcacgtga tgaaaagcc tgaactcacc gcgacgtctg tcgagaagtt     5340
tctgatcgaa aagttcgaca gcgtctccga cctgatgcag ctctcggagg gcgaagaatc    5400
tcgtgctttc agcttcgatg taggagggcg tggatatgtc ctgcgggtaa atagctgcgc    5460
cgatggtttc tacaaagatc gttatgttta tcggcacttt gcatcggccg cgctcccgat    5520
tccggaagtg cttgacattg gggaattcag cgagagcctg acctattgca tctcccgccg    5580
tgcacagggt gtcacgttgc aagacctgcc tgaaaccgaa ctgcccgctg ttctgcagcc    5640
ggtcgcggag gccatggatg cgatcgctgc ggccgatctt agccagacga gcgggttcgg    5700
cccattcgga ccacaaggaa tcggtcaata cactacatgg cgtgatttca tatgcgcgat    5760
tgctgatccc catgtgtatc actggcaaac tgtgatggac gacaccgtca gtgcgtccgt    5820
cgcgcaggct ctcgatgagc tgatgctttg gccgaggac tgccccgaag tccggcacct     5880
cgtgcacgcg gatttcggct ccaacaatgt cctgacggac aatggccgca taacagcggt    5940
cattgactgg agcgaggcga tgttcgggga ttcccaatac gaggtcgcca acatcttctt    6000
ctggaggccg tggttggctt gtatggagca gcagacgcgc tacttcgagc ggaggcatcc    6060
ggagcttgca ggatcgccgc ggctccgggc gtatatgctc cgcattggtc ttgaccaact    6120
ctatcagagc ttggttgacg gcaatttcga tgatgcagct tgggcgcagg gtcgatgcga    6180
cgcaatcgtc cgatccggag ccgggactgt cgggcgtaca caaatcgccc gcagaagcgc    6240
ggccgtctgg accgatggct gtgtagaagt actcgccgat agtggaaacc gacgccccag    6300
cactcgtccg agggcaaagg aatagcacgt gctacgagat ttcgattcca ccgccgcctt    6360
ctatgaaagg ttgggcttcg gaatcgtttt ccgggacgcc ggctggatga tcctccagcg    6420
cggggatctc atgctggagt tcttcgccca ccccaacttg tttattgcag cttataatgg    6480
ttacaaataa agcaatagca tcacaaattt cacaaataaa gcattttttt cactgcattc    6540
```

```
tagttgtggt ttgtccaaac tcatcaatgt atcttatcat gtctgtatac cgtcgacctc      6600
tagctagagc ttggcgtaat catggtcata gctgtttcct gtgtgaaatt gttatccgct      6660
cacaattcca cacaacatac gagccggaag cataaagtgt aaagcctggg gtgcctaatg      6720
agtgagctaa ctcacattaa ttgcgttgcg ctcactgccc gctttccagt cgggaaacct      6780
gtcgtgccag ctgcattaat gaatcggcca acgcgcgggg agaggcggtt tgcgtattgg      6840
gcgctcttcc gcttcctcgc tcactgactc gctgcgctcg tcgttcggc tgcggcgagc       6900 ggtatcagct cactcaaagg cggtaatacg gttatccaca gaatcagggg ataacgcagg      6960
aaagaacatg tgagcaaaag gccagcaaaa ggccaggaac cgtaaaaagg ccgcgttgct      7020
ggcgtttttc cataggctcc gcccccctga cgagcatcac aaaaatcgac gctcaagtca      7080
gaggtggcga aacccgacag gactataaag ataccaggcg tttccccctg gaagctccct      7140
cgtgcgctct cctgttccga ccctgccgct taccggatac ctgtccgcct ttctcccttc      7200
gggaagcgtg cgctttctc atagctcacg ctgtaggtat ctcagttcgg tgtaggtcgt       7260
tcgctccaag ctgggctgtg tgcacgaacc ccccgttcag cccgaccgct gcgccttatc      7320
cggtaactat cgtcttgagt ccaacccggt aagacacgac ttatcgccac tggcagcagc      7380
cactggtaac aggattagca gagcgaggta tgtaggcggt gctacagagt tcttgaagtg      7440
gtggcctaac tacggctaca ctagaagaac agtatttggt atctgcgctc tgctgaagcc      7500
agttaccttc ggaaaaagag ttggtagctc ttgatccggc aaacaaacca ccgctggtag      7560
cggttttttt gtttgcaagc agcagattac gcgcagaaaa aaaggatctc aagaagatcc      7620
tttgatcttt tctacggggt ctgacgctca gtggaacgaa aactcacgtt aagggatttt      7680
ggtcatgaga ttatcaaaaa ggatcttcac ctagatcctt ttaaattaaa aatgaagttt      7740
taaatcaatc taaagtatat atgagtaaac ttggtctgac agttaccaat gcttaatcag      7800
tgaggcacct atctcagcga tctgtctatt tcgttcatcc atagttgcct gactccccgt      7860
cgtgtagata actacgatac gggagggctt accatctggc cccagtgctg caatgatacc      7920
gcgagaccca cgctcaccgg ctccagattt atcagcaata accagccag ccggaagggc       7980 cgagcgcaga agtggtcctg caactttatc cgcctccatc cagtctatta attgttgccg      8040
ggaagctaga gtaagtagtt cgccagttaa tagtttgcgc aacgttgttg ccattgctac      8100
aggcatcgtg gtgtcacgct cgtcgtttgg tatggcttca ttcagctccg gttcccaacg      8160
atcaaggcga gttacatgat cccccatgtt gtgcaaaaaa gcggttagct ccttcggtcc      8220
tccgatcgtt gtcagaagta agttggccgc agtgttatca ctcatggtta tggcagcact      8280
gcataattct cttactgtca tgccatccgt aagatgcttt tctgtgactg gtgagtactc      8340
aaccaagtca ttctgagaat agtgtatgcg gcgaccgagt tgctcttgcc cggcgtcaat      8400
acgggataat accgcgccac atagcagaac tttaaaagtg ctcatcattg gaaaacgttc      8460
ttcggggcga aaactctcaa ggatcttacc gctgttgaga tccagttcga tgtaacccac      8520
tcgtgcaccc aactgatctt cagcatcttt tactttcacc agcgtttctg ggtgagcaaa      8580
aacaggaagg caaaatgccg caaaaaaggg aataagggcg acacggaaat gttgaatact      8640
catactcttc ctttttcaat attattgaag catttatcag ggttattgtc tcatgagcgg      8700
atacatattt gaatgtattt agaaaaataa acaaataggg gttccgcgca catttccccg      8760
aaaagtgcca cctgacg                                                     8777
                                                              SEQ ID NO: 143
tcgacggatc gggagatctc ccgatcccct atggtgcact ctcagtacaa tctgctctga        60
tgccgcatag ttaagccagt atctgctccc tgcttgtgtg ttggaggtcg ctgagtagtg       120
```

-continued

```
cgcgagcaaa atttaagcta caacaaggca aggcttgacc gacaattgtt aattaacatg      180
aagaatctgc ttagggttag gcgttttgcg ctgcttcgct aggtggtcaa tattggccat      240
tagccatatt attcattggt tatatagcat aaatcaatat tggctattgg ccattgcata      300
cgttgtatcc atatcataat atgtacattt atattggctc atgtccaaca ttaccgccat      360
gttgacattg attattgact agttattaat agtaatcaat tacgggtca ttagttcata       420 gcccatatat ggagttccgc gttacataac ttacggtaaa tggcccgcct ggctgaccgc      480
ccaacgaccc ccgcccattg acgtcaataa tgacgtatgt tcccatagta acgccaatag      540
ggactttcca ttgacgtcaa tgggtggagt atttacggta aactgcccac ttggcagtac      600
atcaagtgta tcatatgcca agtacgcccc ctattgacgt caatgacggt aaatggcccg      660
cctggcatta tgcccagtac atgaccttat gggactttcc tacttggcag tacatctacg      720
tattagtcat cgctattacc atggtgatgc ggttttggca gtacatcaat gggcgtggat      780
agcggtttga ctcacgggga tttccaagtc tccaccccat tgacgtcaat gggagtttgt      840
tttggcacca aaatcaacgg gactttccaa aatgtcgtaa caactccgcc ccattgacgc      900
aaatgggcgg taggcgtgta cggtgggagg tctatataag cagagctcgt ttagtgaacc      960
gtcagatcgc ctggagacgc catccacgct gttttgacct ccatagaaga caccgggacc     1020
gatccagcct ccgcggccgg gaacggtgca ttggaatcga tgactctctt aggtagcctt     1080
gcagaagttg gtcgtgaggc actgggcagg taagtatcaa ggttacaaga caggtttaag     1140
gagatcaata gaaactgggc ttgtcgagac agagaagact cttgcgtttc tgataggcac     1200
ctattggtct tactgacatc cactttgcct ttctctccac aggtgtccac tcccagttca     1260
attacagctc gccaccatgc ggttctccgc tcagctgctg gccttctgg tgctgtggat      1320 tcccggcgtc tcgagatcta tcgatgcatg ccatggtacc aagcttgcca ccatgagcag     1380
cagctcttgg ctgctgctga gcctggtggc cgtgacagcc gcccagagca ccatcgagga     1440
gcaggccaag accttcctgg acaagttcaa ccacgaggcc gaggacctgt tctaccagag     1500
cagcctggcc agctggaact acaacaccaa catcaccgag gagaacgtgc agaacatgaa     1560
caacgccggc gacaagtgga gcgccttcct gaaggagcag agcacactgg cccagatgta     1620 cccccctgcag gagatccaga acctgaccgt gaagctgcag ctgcaggccc tgcagcagaa     1680
cggcagcagc gtgctgagcg aggacaagag caagcggctg aacaccatcc tgaacaccat     1740
gtccaccatc tacagcaccg gcaaagtgtg caaccccgac aaccccagg agtgcctgct      1800 gctggagccc ggcctgaacg agatcatggc caacagcctg gactacaacg agcggctgtg     1860
ggcctgggag agctggcgga gcgaagtggg caagcagctg cggcccctgt acgaggagta     1920
cgtggtgctg aagaacgaga tggccagggc caaccactac gaggactacg gcgactactg     1980
gagaggcgac tacgaagtga acggcgtgga cggctacgac tacagcagag ccagctgat      2040 cgaggacgtg gagcacacct tcgaggagat caagcctctg tacgagcacc tgcacgccta     2100
cgtgcgggcc aagctgatga acgcctaccc cagctacatc agccccatcg gctgcctgcc     2160
cgcccacctg ctgggcgaca tgtggggccg gttctggacc aacctgtaca gcctgaccgt     2220 gccccttcggc cagaagccca acatcgacgt gaccgacgcc atggtggacc aggcctggga     2280
cgcccagcgg atcttcaagg aggccgagaa gttcttcgtg agcgtgggcc tgcccaacat     2340
gacccagggc ttttgggaga acagcatgct gaccgaccc ggcaatgtgc agaaggccgt      2400
gtgccacccc accgcctggg acctgggcaa gggcgacttc cggatcctga tgtgcaccaa     2460
agtgaccatg gacgacttcc tgaccgccca ccacgagatg ggccacatcc agtacgacat     2520
ggcctacgcc gcccagccct tcctgctgcg gaacggcgcc aacgagggct tcacgaggc      2580
```

-continued

```
cgtgggcgag atcatgagcc tgagcgccgc caccccaag cacctgaaga gcatcggcct    2640
gctgagcccc gacttccagg aggacaacga gaccgagatc aacttcctgc tgaagcaggc    2700
cctgaccatc gtgggcaccc tgcccttcac ctacatgctg gagaagtggc ggtggatggt    2760
gtttaagggc gagatcccca aggaccagtg gatgaagaag tggtgggaga tgaagcggga    2820
gatcgtgggc gtggtggagc ccgtgcccca cgacgagacc tactgcgacc ccgccagcct    2880
gttccacgtg agcaacgact actccttcat ccggtactac acccggaccc tgtaccagtt    2940
ccagttccag gaggccctgt gccaggccgc caagcacgag ggcccctgc acaagtgcga    3000 catcagcaac agcaccgagg ccggacagaa actgttcaac atgctgcggc tgggcaagag    3060
cgagccctgg accctggccc tggagaatgt ggtgggcgcc aagaacatga atgtgcgccc    3120
cctgctgaac tacttcgagc ccctgttcac ctggctgaag gaccagaaca gaacagctt    3180 cgtgggctgg agcaccgact ggagccccta cgccgaccag agcatcaaag tgcggatcag    3240
cctgaagagc gccctgggcg acaaggccta cgagtggaac gacaacgaga tgtacctgtt    3300
ccggagcagc gtggcctatg ccatgcggca gtacttcctg aaagtgaaga accagatgat    3360
cctgttcggc gaggaggacg tgagagtggc caacctgaag ccccggatca gcttcaactt    3420
cttcgtgacc gcccccaaga acgtgagcga catcatcccc cggaccgaag tggagaaggc    3480
catccggatg agccggagcc ggatcaacga cgccttccgg ctgaacgaca actccctgga    3540
gttcctgggc atccagccca ccctgggccc tccaaccag ccccccgtga gcatctggct    3600
gatcgtgttt ggcgtggtga tgggcgtgat cgtggtggga atcgtgatcc tgatcttcac    3660
cggcatccgg gaccggaaga agaagaacaa ggcccgagc ggcgagaacc cctacgccag    3720
catcgatatc agcaagggcg agaacaaccc cggcttccag aacaccgacg acgtgcagac    3780
cagcttctga taatctagaa cgagctcgaa ttcgaagctt ctgcagacgc gtcgacgtca    3840
tatggatccg atatcgccgt ggcggccgca ggccagccca aggccgctcc cagcgtgacc    3900
ctgttccccc cctcctccga ggagctgcag gccaacaagg ccaccctggt gtgcctcatc    3960
agcgacttct accctggcgc cgtgaccgtg gcctggaagg ccgacagcag ccccgtgaag    4020
gccggcgtgg agaccaccac ccccagcaag cagagcaaca caagtacgc cgccagcagc    4080 tacctgagcc tcaccccga gcagtggaag agccaccgga gctacagctg ccaggtgacc    4140
cacgagggca gcaccgtgga gaagaccgtg gcccccaccg agtgcagcta atagacttaa    4200
gtttaaaccg ctgatcagcc tcgactgtgc cttctagttg ccagccatct gttgtttgcc    4260
cctcccccgt gccttccttg accctggaag gtgccactcc cactgtcctt tcctaataaa    4320
atgaggaaat tgcatcgcat tgtctgagta ggtgtcattc tattctgggg ggtggggtgg    4380
ggcaggacag caaggggag gattgggaag acaatagcag gcatgctggg gatgcggtgg    4440
gctctatggc ttctgaggcg gaaagaacca gctgggctc taggggtat ccccacgcgc    4500 cctgtagcgg cgcattaagc gcggcgggtg tggtggttac gcgcagcgtg accgctacac    4560
ttgccagcgc cctagcgccc gctcctttcg ctttcttccc ttcctttctc gccacgttcg    4620
ccggctttcc ccgtcaagct ctaaatcggg ggctccctt agggttccga tttagtgctt    4680
tacggcacct cgaccccaaa aaacttgatt agggtgatgg ttcacgtagt gggccatcgc    4740
cctgatagac ggttttcgc cctttgacgt tggagtccac gttctttaat agtggactct    4800
tgttccaaac tggaacaaca ctcaacccta tctcggtcta ttcttttgat ttataaggga    4860
ttttggccat tcggcctat tggttaaaaa atgagctgat ttaacaaaaa tttaacgcga    4920
attaattctg tggaatgtgt gtcagttagg gtgtggaaaa tccccaggct ccccagcagg    4980
cagaagtatg caaagcatgc atctcaatta gtcagcaacc aggtgtggaa agtccccagg    5040
```

```
ctccccagca ggcagaagta tgcaaagcat gcatctcaat tagtcagcaa ccatagtccc      5100
gcccctaact ccgcccatcc cgcccctaac tccgcccagt tccgcccatt ctccgcccca      5160
tggctgacta attttttta tttatgcaga ggccgaggcc gcctctgcct ctgagctatt      5220
ccagaagtag tgaggaggct tttttggagg cctaggcttt tgcaaaaagc tcccgggagc      5280
ttgtatatcc attttcggat ctgatcagca cgtgatgaaa aagcctgaac tcaccgcgac      5340
gtctgtcgag aagtttctga tcgaaaagtt cgacagcgtc tccgacctga tgcagctctc      5400
ggagggcgaa gaatctcgtg ctttcagctt cgatgtagga gggcgtggat atgtcctgcg      5460
ggtaaatagc tgcgccgatg gtttctacaa agatcgttat gtttatcggc actttgcatc      5520
ggccgcgctc ccgattccgg aagtgcttga cattgggaa ttcagcgaga gcctgaccta      5580
ttgcatctcc cgccgtgcac agggtgtcac gttgcaagac ctgcctgaaa ccgaactgcc      5640
cgctgttctg cagccggtcg cggaggccat ggatgcgatc gctgcggccg atcttagcca      5700
gacgagcggg ttcggcccat tcggaccgca aggaatcggt caatacacta catggcgtga      5760
tttcatatgc gcgattgctg atccccatgt gtatcactgg caaactgtga tggacgacac      5820
cgtcagtgcg tccgtcgcgc aggctctcga tgagctgatg ctttgggccg aggactgccc      5880
cgaagtccgg cacctcgtgc acgcggattt cggctccaac aatgtcctga cggacaatgg      5940
ccgcataaca gcggtcattg actggagcga ggcgatgttc ggggattccc aatacgaggt      6000
cgccaacatc ttcttctgga ggccgtggtt ggcttgtatg gagcagcaga cgcgctactt      6060
cgagcggagg catccggagc ttgcaggatc gccgcggctc cgggcgtata tgctccgcat      6120
tggtcttgac caactctatc agagcttggt tgacggcaat ttcgatgatg cagcttgggc      6180
gcagggtcga tgcgacgcaa tcgtccgatc cggagccggg actgtcgggc gtacacaaat      6240
cgcccgcaga agcgcggccg tctggaccga tggctgtgta gaagtactcg ccgatagtgg      6300
aaaccgacgc cccagcactc gtccgagggc aaaggaatag cacgtgctac gagatttcga      6360
ttccaccgcc gccttctatg aaaggttggg cttcggaatc gttttccggg acgccggctg      6420
gatgatcctc cagcgcgggg atctcatgct ggagttcttc gcccacccca acttgtttat      6480
tgcagcttat aatggttaca aataaagcaa tagcatcaca aatttcacaa ataaagcatt      6540
tttttcactg cattctagtt gtggtttgtc caaactcatc aatgtatctt atcatgtctg      6600
tataccgtcg acctctagct agagcttggc gtaatcatgg tcatagctgt ttcctgtgtg      6660
aaattgttat ccgctcacaa ttccacacaa catacgagcc ggaagcataa agtgtaaagc      6720
ctggggtgcc taatgagtga gctaactcac attaattgcg ttgcgctcac tgcccgcttt      6780
ccagtcggga aacctgtcgt gccagctgca ttaatgaatc ggccaacgcg cggggagagg      6840
cggtttgcgt attgggcgct cttccgcttc ctcgctcact gactcgctgc gctcggtcgt      6900
tcggctgcgg cgagcggtat cagctcactc aaaggcggta atacggttat ccacagaatc      6960 agggataac gcaggaaaga acatgtgagc aaaaggccag caaaaggcca ggaaccgtaa      7020
aaaggccgcg ttgctggcgt ttttccatag gctccgcccc cctgacgagc atcacaaaaa      7080
tcgacgctca agtcagaggt ggcgaaaccc gacaggacta taaagatacc aggcgtttcc      7140
ccctggaagc tccctcgtgc gctctcctgt tccgaccctg ccgcttaccg gatacctgtc      7200
cgcctttctc ccttcgggaa gcgtggcgct ttctcatagc tcacgctgta ggtatctcag      7260
ttcggtgtag tcgttcgct ccaagctggg ctgtgtgcac gaaccccccg ttcagcccga      7320
ccgctgcgcc ttatccggta actatcgtct tgagtccaac ccggtaagac acgacttatc      7380
gccactggca gcagccactg gtaacaggat tagcagagcg aggtatgtag gcggtgctac      7440
agagttcttg aagtggtggc ctaactacgg ctacactaga agaacagtat ttggtatctg      7500
```

-continued

```
cgctctgctg aagccagtta ccttcggaaa aagagttggt agctcttgat ccggcaaaca    7560
aaccaccgct ggtagcggtt ttttttgtttg caagcagcag attacgcgca gaaaaaaagg    7620
atctcaagaa gatcctttga tcttttctac ggggtctgac gctcagtgga acgaaaactc    7680
acgttaaggg attttggtca tgagattatc aaaaaggatc ttcacctaga tccttttaaa    7740
ttaaaaatga agttttaaat caatctaaag tatatatgag taaacttggt ctgacagtta    7800
ccaatgctta atcagtgagg cacctatctc agcgatctgt ctatttcgtt catccatagt    7860
tgcctgactc cccgtcgtgt agataactac gatacgggag ggcttaccat ctggccccag    7920
tgctgcaatg ataccgcgag acccacgctc accggctcca gatttatcag caataaacca    7980
gccagccgga agggccgagc gcagaagtgg tcctgcaact ttatccgcct ccatccagtc    8040
tattaattgt tgccgggaag ctagagtaag tagttcgcca gttaatagtt tgcgcaacgt    8100
tgttgccatt gctacaggca tcgtggtgtc acgctcgtcg tttggtatgg cttcattcag    8160
ctccggttcc caacgatcaa ggcgagttac atgatccccc atgttgtgca aaaaagcggt    8220
tagctccttc ggtcctccga tcgttgtcag aagtaagttg gccgcagtgt tatcactcat    8280
ggttatggca gcactgcata attctcttac tgtcatgcca tccgtaagat gcttttctgt    8340
gactggtgag tactcaacca agtcattctg agaatagtgt atgcggcgac cgagttgctc    8400
ttgcccggcg tcaatacggg ataataccgc gccacatagc agaactttaa aagtgctcat    8460
cattggaaaa cgttcttcgg ggcgaaaact ctcaaggatc ttaccgctgt tgagatccag    8520
ttcgatgtaa cccactcgtg cacccaactg atcttcagca tcttttactt tcaccagcgt    8580
ttctgggtga gcaaaaacag gaaggcaaaa tgccgcaaaa aagggaataa gggcgacacg    8640
gaaatgttga atactcatac tcttcctttt tcaatattat tgaagcattt atcagggtta    8700
ttgtctcatg agcggataca tatttgaatg tatttagaaa aataaacaaa taggggttcc    8760
gcgcacattt ccccgaaaag tgccacctga cg                                   8792
                                                              SEQ ID NO: 212
gaggtccagc tggtgcagtc tggggctgag gtgaagaagc ctggggcctc agtgaaggtc      60
tcctgcaagg cttctgggta caccttcacc ggctactatg tgtactgggt gcgacaggcc     120
cctggacaag ggcttgagtg gatgggatgg atcagcgctt acaatggtaa cacaaactat     180
gcacagaagt tccagggcag agtcacgatt accgcggaca atccacgag cacagcctac      240 atggagctga gcagcctgag atctgaagac acggctgtgt attactgtgc gagaagtaga     300
tccctggacg tctggggcca agggaccacg gtcaccgtct cgagcggtac gggcggttca     360
ggcggaaccg gcagcggcac tggcgggtcg acggatgttg tgatgactca gtctccagac     420
tccctggctg tgtctctggg cgagagggcc accatcaact gcaagtccag ccagagtgtt     480
ttatacagct ccaacaataa gaactactta gcttggtacc agcagaaacc aggacagcct     540
cctaagctgc tcatttactg ggcatctacc cgggaatccg gggtccctga ccgattcagt     600
ggcagcgggt ctgggacaga tttcactctc accatcagca gcctgcaggc tgaagatgtg     660
gcagtttatt actgtcagca atattatagt actcctctca ctttcggcgg agggaccaaa     720
gtggatatca aacgt                                                      735
                                                              SEQ ID NO: 213
E V Q L V Q S G A E V K K P G A S V K V S C K A S G Y T F T G Y Y V Y W V R
Q A P G Q G L E W M G W I S A Y N G N T N Y A Q K F Q G R V T I T A D K S T
S T A Y M E L S S L R S E D T A V Y Y C A R S R S L D V W G Q G T T V T V S
S G T G G S G G T G S G T G G S T D V V M T Q S P D S L A V S L G E R A T I
N C K S S Q S V L Y S S N N K N Y L A W Y Q Q K P G Q P P K L L I Y W A S T
```

-continued

R E S G V P D R F S G S G S G T D F T L T I S S L Q A E D V A V Y Y C Q Q Y

Y S T P L T F G G G T K V D I K R

SEQ ID NO: 214

```
cagatgcagc tggtgcagtc tggggctgag gtgaagaagc ctgggtcctc ggtgaaggtc        60
tcctgcaagg cttctggagg caccttctcc agttatgcta tcacctgggt gcgacaggcc       120
cctggacaag gcttgagtg gatgggaggg atcatcggta tgtttggttc aacaaactac        180
gcacagaact tccagggcag agtcacgatt accgcggacg aatccacgag cacagcctac       240
atggagctga gcagcctcag atctgaggac acggccgtgt attactgtgc gagaagtact       300
ggttattacc ctgcatacct ccaccactgg ggccagggca ccctggtcac cgtctcgagc       360
ggtacgggcg gttcaggcgg aaccggcagc ggcactggcg gtcgacgca gtctgccctg        420
actcagcctc gctcagtgtc cgggtctcct ggacagtcag tcaccatctc ctgcactgga       480
accagcagtg atgttggtgg ttataactat gtctcctggt accaacagca cccaggcaaa       540
gcccccaaac tcatgattta tgatgtcagt aagcggccct cagggtccc tgatcgcttc        600
tctggctcca agtctggcaa cacggcctcc ctgaccatct ctgggctcca ggctgaggat       660
gaggctgatt attactgcag ctcatataca agcagcagca ctcatgtctt cggaactggg       720
accaaggtca ccgtcctagg t                                                 741
```

SEQ ID NO: 215

Q M Q L V Q S G A E V K K P G S S V K V S C K A S G G T F S S Y A I T W V R

Q A P G Q G L E W M G G I I G M F G S T N Y A Q N F Q G R V T I T A D E S T

S T A Y M E L S S L R S E D T A V Y Y C A R S T G Y Y P A Y L H H W G Q G T

L V T V S S G T G G S G G T G S G T G G S T Q S A L T Q P R S V S G S P G Q

S V T I S C T G T S S D V G G Y N Y V S W Y Q Q H P G K A P K L M I Y D V S

K R P S G V P D R F S G S K S G N T A S L T I S G L Q A E D E A D Y Y C S S

Y T S S S T H V F G T G T K V T V L G

SEQ ID NO: 216

```
gaggtgcagc tggtggagac cggggctgag gtgaagaagc ctggggcctc agtgaaggtt        60
tcctgcaagg catctggata caccttcacc agctactata tgcactgggt gcgacaggcc       120
cctggacaag gcttgagtg gatgggatgg atcaaccta acagtggtgg cacaaactat         180
gcacagaagt tcagggcag ggtcaccatg accagggaca cgtccatcag cacagcctac        240
atggagctga gcaggctgag atctgacgac acggccgtgt attactgtgc gagagaggg        300
aaatggggac tcaagcggc ttttgatatc tggggccaag gacaatggt caccgtctcg         360
agcggtacgg gcggttcagg cggaaccggc agcggcactg gcgggtcgac ggaaattgtg       420
atgacgcagt ctccaggcac cctgtctttg tctccagggg aaagagccac cctctcctgc       480
agggccagtc agagtgttag cagcagctac ttagcctggt accagcagaa acctggccag       540
gctcccaggc tcctcatcta tgatgcatcc agcagggcca ctgacatccc agacaggttc       600
agtggcagtg ggtctgggac agacttcact ctcaccatca gcagactgga gcctgaagat       660
tttgcagtgt attactgtca gcagtatggt agctcacttt ggacgttcgg ccaagggacc       720
aaggtggaga tcaaacgt                                                     738
```

SEQ ID NO: 217

E V Q L V E T G A E V K K P G A S V K V S C K A S G Y T F T S Y Y M H W V R

Q A P G Q G L E W M G W I N P N S G G T N Y A Q K F Q G R V T M T R D T S I

S T A Y M E L S R L R S D D T A V Y Y C A R E G K W G P Q A A F D I W G Q

T M V T V S S G T G G S G G T G S G T G G S T E I V M Q S P G T L S L S P

-continued

G E R A T L S C R A S Q S V S S S Y L A W Y Q Q K P G Q A P R L L I Y D A S
S R A T D I P D R F S G S G S T D F T L T I S R L E P E D F A V Y Y C Q Q
Y G S S L W T F G Q G T K V E I K R

SEQ ID NO: 218

```
gaggtgcagc tggtagagtc tgggggaggc ttggtacagc ctggggggtc cctgagactc    60
tcctgtgcag cctctggatt cacctttagc atctatgcca tgagctgggt ccgccaggca   120
ccagggaagg gctggagtg gtctcagct attagtagta gtggtgatag cacatactac    180
gcagactccg tgaagggccg gttcaccatc tccagagaca acgccaggaa cacgctgtat   240
ctgcaaatga acagtctgag agccgaggac acggctgtgt attactgtgc gagagcgtat   300
ggctacacgt tcgacccctg gggccaggga accctggtca ccgtctcgag cggtacgggc   360
ggttcaggcg gaaccggcag cggcactggc gggtcgacgg aaattgtgct gactcagtct   420
ccactctccc tgcccgtcac cctggagag ccggcctcca tctcctgcag gtctagtcag   480
agcctcctgc atagtaatgg atacaactat ttggattggt acctgcagaa gccagggcag   540
tctccacagc tcctgatcta tttgggttct aatcgggcct ccggggtccc tgacaggttc   600
agtggcagtg gatcaggcac agattttaca ctgaaaatca gcagtgga ggctgaggat   660
gttggggttt attactgcat gcaagctcta caaactcccc tcactttcgg cggagggacc   720
aaggtggaga tcaaacgt                                                 738
```

SEQ ID NO: 219

E V Q L V E S G G G L V Q P G G S L R L S C A A S G F T F S I Y A M S W V R
Q A P G K G L E W V S A I S S S G D S T Y Y A D S V K G R F T I S R D N A R
N T L Y L Q M N S L R A E D T A V Y Y C A R A Y G Y T F D P W G Q G T L V T
V S S G T G G S G G T G S G T G G S T E I V L T Q S P L S L P V T P G E P A
S I S C R S S Q S L L H S N G Y N Y L D W Y L Q K P G Q S P Q L L I Y L G S
N R A S G V P D R F S G S G S T D F T L K I S R V E A E D V G V Y Y C M Q
A L Q T P L T F G G G T K V E I K R

SEQ ID NO: 220

```
gaggtgcagc tggtggagac cggggctgag gtgaagaagc ctgggtcctc ggtgaaggtc    60
tcctgcaagg cctctggagg caccttcagg acccatgcta tcagttgggt gcgacaggcc   120
cctggacaag gcttgagtg gatgggaggg atcatcgcta tcttcggaac agcaaactac   180
gcacagaagt tccagggcag aatcacgatt accgcggacg aatccacgag tacagcctac   240
atggagctga gcagcctgag atctgaggac acggccgtgt atttctgtgc gagaggcagt   300
ggttatcata tatcgacacc ctttgacaac tggggccagg aaccctggt caccgtctcg    360
agcggtacgg gcggttcagg cggaaccggc agcggcactg gcgggtcgac gtcctatgtg   420
ctgactcagc caccctcggt gtcagtggcc ccaggacaga cggccaggat tacctgtggg   480
ggaaacaaca ttggaagtaa aggtgtgcac tggtaccagc agaagcctgg ccaggcccct   540
gtgctggtcg tctatgatga tagcgaccgg ccctcaggga tccctgagcg attctctggc   600
tccaactctg gaacacggc caccctgacc atcagcaggg tcgaagccgg ggatgaggcc   660
gactattact gtcaggtgtg ggatagtagt agtgatcatg tggtattcgg cggagggacc   720
aagctgaccg tcctaggt                                                 738
```

SEQ ID NO: 221

E V Q L V E T G A E V K K P G S S V K V S C K A S G G T F R T H A I S W V R
Q A P G Q G L E W M G G I I A I F G T A N Y A Q K F Q G R I T I T A D E S T
S T A Y M E L S S L R S E D T A V Y F C A R G S G Y H I S T P F D N W G Q G

-continued

T L V T V S S G T G G S G G T G S G T G G S T S Y V L T Q P P S V S V A P G
Q T A R I T C G G N N I G S K G V H W Y Q Q K P G Q A P V L V V Y D D S D R
P S G I P E R F S G S N S G N T A T L T I S R V E A G D E A D Y Y C Q V W D
S S S D H V V F G G G T K L T V L G

SEQ ID NO: 222

```
gaggtgcagc tggtggagtc tggggctgag gtgaagaagc ctgggtcctc ggtgaaggtc    60
tcctgcaagg cttctggaca catcttcagc ggctatgcaa tcagttgggt gcgacaggcc   120
cctggacaag ggcttgagtg gatgggaggg atcatccctg tctttggtac aacaaactac   180
gcacagaagt tccagggcag agtcacgatt accgcggacc aatccacgag cacagcctac   240
atggacctga gcaacttgag atctgaggac acggccgtct attactgtgc gagagtgaaa   300
gatggatatt gtactcttac cagctgccct gtcggctggt acttcgatct ctggggccgt   360
ggcaccctgg tcactgtctc gagcggtacg ggcggttcag gcggaaccgg cagcggcact   420
ggcgggtcga cggaaattgt gatgacgcag tctccaggca ccctgtcttt gtctccaggg   480
gaaagagcca ccctctcgtg cagggccagt cagagtgtta gcagcagcta cttagcctgg   540
taccagcaga aacctggcca ggctcccagg ctcctcatct tggtgcctc cagcagggcc   600
actggcatcc cagacaggtt cagtggcagt gggtctggga cagacttcac tctcaccatc   660
agcagactgg agcctgaaga ttttgcagtg tattactgtc agcagtatgg tagctcactc   720
actttcggcg gagggaccaa gctggagatc aaacgt                             756
```

SEQ ID NO: 223

E V Q L V E S G A E V K K P G S S V K V S C K A S G H I F S G Y A I S W V R
Q A P G Q G L E W M G G I I P I F G T T N Y A Q K F Q G R V T I T A D Q S T
S T A Y M D L S N L R S E D T A V Y Y C A R V K D G Y C T L T S C P V G W Y
F D L W G R G T L V T V S S G T G G S G G T G S G T G G S T E I V M T Q S P
G T L S L S P G E R A T L S C R A S Q S V S S S Y L A W Y Q Q K P G Q A P R
L L I F G A S S R A T G I P D R F S G S G S G T D F T L T I S R L E P E D F
A V Y Y C Q Q Y G S S L T F G G G T K L E I K R

SEQ ID NO: 224

```
gaggtccagc tggtacagtc tggggctgag gttaagaagc ctgggtcctc ggtgaaggtc    60
tcctgcaagg cttctggagg catcttcaga agcaattcta tcagttgggt gcgacaggcc   120
cctgggcaag ggcttgagtg gatgggaggg atcttcgctc ttttcggaac aacagactac   180
gcgcagaagt tccagggcag agtcacgatt accgcggacg aatcttcgac cacagtctac   240
ctggagctga gtagcctgac atctgaggac acggccgttt attactgtgc gagaggcagt   300
ggctacacca cacgcaacta ctttgactac tggggccagg gcaccctggt caccgtctcg   360
agcggtacgg gcggttcagg cggaaccggc agcggcactg gcgggtcgac ggaaattgtg   420
ctgactcagt ctccaggcac cctgtctttg tctccagggg aaagagccac actcctgc    480
agggccagtc agagtgttag cagcaactac ttaggctggt accagcagaa acctggccag   540
gctcccaggc tcctgatcta tggtgcatcc agcagggcca gtggcatccc agacaggttc   600
agtggcggtg ggtctgggac agacttcact ctcaccatca gcagactgga gcctgaagat   660
tttgcagtgt attactgtca gcagtatggt agctcacccc tcactttcgg cggagggacc   720
aaggtggaga tcaaacgt                                                 738
```

SEQ ID NO: 225

E V Q L V Q S G A E V K K P G S S V K V S C K A S G G I F R S N S I S W V R
Q A P G Q G L E W M G G I F A L F G T T D Y A Q K F Q G R V T I T A D E S S

```
                                    -continued
T T V Y L E L S S L T S E D T A V Y Y C A R G S G Y T T R N Y F D Y W G Q G
T L V T V S S G T G G S G G T G S G T G G S T E I V L T Q S P G T L S L S P
G E R A T L S C R A S Q S V S S N Y L G W Y Q Q K P G Q A P R L L I Y G A S
S R A S G I P D R F S G G G S G T D F T L T I S R L E P E D F A V Y Y C Q Q
Y G S S P L T F G G G T K V E I K R
```

SEQ ID NO: 226
```
caggtgcagc tggtgcagtc tggggctgag gtgaagaagc ctgggtcctc ggtaaaggtc    60
tcctgcaagg cttctggagg ccccttccgc aattttgcta tcaactgggt gcgacaggcc   120
cctggacaag gcttgagtg gatgggaggg atcatcgctg tctttgggac gacaaagtac   180
gcacataagt tccagggcag agtcaccatc accgcggacg actccacaaa tacagcttac   240
atggagctgg gcagcctgaa atctgaggac acggccgtgt attactgtgc gagaggtccc   300
cactactact cctcctacat ggacgtctgg ggcgaaggga ccacggtcac cgtctcgagc   360
ggtacgggcg ttcaggcgg aaccggcagc ggcactggcg gtcgacgga catccagttg   420
acccagtctc catcctccct gtctgcatct gtaggagaca gagtcaccat cacttgccgg   480
gcgagtcagg gcattagcac ttatttagcc tggtatcagc agaaacccgg aaagttcct    540
aaactcctga tctatgctgc atccactttg caatcagggg tcccatctcg gttcagtggc   600
agtggatctg gacagattt cactctcacc atcagcagcc tgcagcctga agatgttgca    660
acttattact gtcaaaagta taacagtgcc ccttctttcg gccctgggac caaagtggat   720
atcaaacgt                                                          729
```

SEQ ID NO: 227
```
Q V Q L V Q S G A E V K K P G S S V K V S C K A S G G P F R N F A I N W V R
Q A P G Q G L E W M G G I I A V F G T T K Y A H K F Q G R V T I T A D D S T
N T A Y M E L G S L K S E D T A V Y Y C A R G P H Y Y S S Y M D V W G E G T
T V T V S S G T G G S G G T G S G T G G S T D I Q L T Q S P S S L S A S V G
D R V T I T C R A S Q G I S T Y L A W Y Q Q K P G K V P K L L I Y A A S T L
Q S G V P S R F S G S G S G T D F T L T I S S L Q P E D V A T Y Y C Q K Y N
S A P S F G P G T K V D I K R
```

SEQ ID NO: 228
```
gaggtgcagc tggtggagac tggggctgag gtgaagaagc ctgggtcctc ggtgaaggtc    60
ccctgcaaat cttctggaag ccccttcagg agtaatgctg tcagctgggt gcgacaggcc   120
cccggacaag gcttgagtg ggtgggagga atcctcggtg tctttggttc accaagctac   180
gcacagaagt tccagggcag agtcacgatt accgcggacg aatccaccaa cacagtccac   240
atggagctga gaggtttgag atctgaggac acggccgtgt attattgtgc gagaggtcct   300
acctactact actcctacat ggacgtctgg ggcaaaggga ccacggtcac cgtctcgagc   360
ggtacgggcg ttcaggcgg aaccggcagc ggcactggcg gtcgacgtc ctatgtgctg    420
actcagccac cctcggagtc agtggcccca ggacagacgg ccaggattac ctgtggggga   480
aataacattg gaagaaatag tgtgcactgg tatcagcaga agccaggcca ggcccctgtg   540
ctggtcgtgt atgatgatag cgaccggccc tcagggatcc ctgagcgatt ttctggctcc   600
aagtctggga acacggccac cctgattatc agcagggtcg aagtcgggga tgaggccgac   660
tactactgtc aggtgtggca tagtagtagt gatcattatg tcttcggaac tgggaccaag   720
gtcaccgtcc taggt                                                   735
```

SEQ ID NO: 229
EVQLVETGAEVKKPGSSVKVPCKSSGSPFRSNAVSWVR
QAPGQGLEWVGGILGVFGSPSYAQKFQGRVTITADEST
NTVHMELRGLRSEDTAVYYCARGPTYYYSYMDVWGKGT
TVTVSSGTGGSGGTGSGTGGSTSYVLTQPPSESVAPGQ
TARITCGGNNIGRNSVHWYQQKPGQAPVLVVYDDSDRP
SGIPERFSGSKSGNTATLIISRVEVGDEADYYCQVWHS
SSDHYVFGTGTKVTVLG

SEQ ID NO: 230
```
cagatgcagc tggtacaatc tggagctgag gtgaagaagc ctgggtcctc ggtgaaggtc    60
tcctgcaagg cttctggagg caccttcagc agctatgcta tcagctgggt gcgacaggcc   120
cctggacaag gcttgagtg gatgggaggg atcttcggta tgtttgggac agcaaactac   180
gcgcagaagt tccagggcag agtcacgatt accgcggacg aattcacgag cgcggcctac   240
atggagctga gcagcctggg atctgaggac acggccatgt attactgtgc gaggtctagt   300
ggttattacc cccaatactt ccaggactgg ggccagggca ccctggtcac cgtctcgagc   360
ggtacgggcg ttcaggcgg aaccggcagc ggcactggcg gtcgacgga aattgtgatg   420
acacagtctc caggcaccct gtctttgtct ccagggcaaa gagccaccct ctcctgcagg   480
gccagtcaga gtgttagcag cagctactta gcctggtacc agcagaaacc tggccaggct   540
cccagactcc tcatgtatgg tgcatccagc agggccactg gcatcccaga caggttcagt   600
ggcagtgggt ctgggacaga cttcactctc accatcagca gactggagcc tgaagatttt   660
gcagtgtatt actgtcagca gtatggtagc tcatcgctca ctttcggcgg agggaccaag   720
ctggagatca aacgt                                                   735
```

SEQ ID NO: 231
QMQLVQSGAEVKKPGSSVKVSCKASGGTFSSYAISWVR
QAPGQGLEWMGGIFGMFGTANYAQKFQGRVTITADEFT
SAAYMELSSLGSEDTAMYYCARSSGYYPQYFQDWGQGT
LVTVSSGTGGSGGTGSGTGGSTEIVMTQSPGTLSLPG
QRATLSCRASQSVSSSYLAWYQQKPGQAPRLLMYGASS
RATGIPDRFSGSGSGTDFTLTISRLEPEDFAVYYCQQY
GSSSLTFGGGTKLEIKR

SEQ ID NO: 232
```
gaggtgcagc tggtggagtc cggggctgag gtgaagaagc ctgggtcctc ggtgaaggtc    60
tcctgcaagg cttctggagg catcttcaac agttatgcta tcagctgggt gcgacaggcc   120
cctggacaag gcttgagtg gatgggaggc atcatcgcta tctttcatac accaaagtac   180
gcacagaagt tccagggcag agtcacgatt accgcggacg aatccacgaa cacagcctac   240
atggaactga aagcctgaa atctgaggac acggccctgt attactgtgc gagagggtcc   300
acttacgatt tttcgagtgg ccttgactac tggggccagg gaaccctggt caccgtctcg   360
agcggtacgg gcgttcagg cggaaccggc agcggcactg gcgggtcgac gcaggcaggg   420
ctgactcagc caccctcggt gtcagtggcc ccaggacaga cggccaggat tacctgtggg   480
ggaaacaaca ttggaagtaa aagtgtgcac tggtaccagc agaagccagg ccaggcccct   540
gtcctagtcg tctatgatga tagcgaccgg ccctcaggga tccctgagcg attctctggc   600
tccaactctg ggaacacggc cacccctgacc atcagcaggg tcgaagccgg ggatgaggcc   660
```

```
gactattact gtcaggtgtg ggatagtagt agtgatcatg tggtattcgg cggagggacc    720
aagctgaccg tcctaggt                                                  738
```

SEQ ID NO: 233
```
E V Q L V E S G A E V K K P G S S V K V S C K A S G G I F N S Y A I S W V R
Q A P G Q G L E W M G G I I A I F H T P K Y A Q K F Q G R V T I T A D E S T
N T A Y M E L R S L K S E D T A L Y Y C A R G S T Y D F S S G L D Y W G Q G
T L V T V S S G T G G S G G T G S G T G G S T Q A G L T Q P P S V S V A P G
Q T A R I T C G G N N I G S K S V H W Y Q Q K P G Q A P V L V V Y D D S D R
P S G I P E R F S G S N S G N T A T L T I S R V E A G D E A D Y Y C Q V W D
S S S D H V V F G G G T K L T V L G
```

SEQ ID NO: 234
```
caggtccagc tggtgcagtc tggggctgag gtgaagaagc ctgggtcctc ggtgaaggtc    60
tcctgcaagg cttctggagg cttcttcagc agctatgcta tcagctgggt gcgccaggcc   120
cctggacaag gacttgagtg gatggggggg gtcatcccta tctttcgtac agcaaactac   180
gcacagaact tccagggcag agtcaccatt accgcggacg aattcacatc gtatatggag   240
ctgagcagcc tgagatctga cgacacggcc gtgtattact gtgcgaggtt gaattaccat   300
gattcgggga cttattataa cgccccccgg ggctggttcg acccctgggg ccagggaacc   360
ctggtcaccg tctcgagcgg tacgggcggt tcaggcggaa ccggcagcgg cactggcggg   420
tcgacggaca tccagatgac ccagtctcca gactccctgg ctgtgtctct gggcgagaag   480
gccaccatca actgcaagtc cagccagagt atttaaaca gctccaacaa taagaactac   540
ttagcttggt accagcagaa accaggacag cctcctaagc tgctcattta ctgggcatct   600
acccgggaat ccggggtccc tgaccgattc agtggcagcg gtctgggac agatttcact   660
ctcaccatca gcagcctgca ggctgaagat gtggcagttt attactgtca gcaatattat   720
agtagtccgc cgacgttcgg ccaagggacc aaggtggaaa tcaaacgt             768
```

SEQ ID NO: 235
```
Q V Q L V Q S G A E V K K P G S S V K V S C K A S G G F F S S Y A I S W V R
Q A P G Q G L E W M G G V I P I F R T A N Y A Q N F Q G R V T I T A D E F T
S Y M E L S S L R S D D T A V Y Y C A R L N Y H D S G T Y Y N A P R G W F D
P W G Q G T L V T V S S G T G G S G G T G S G T G G S T D I Q M T Q S P D S
L A V S L G E K A T I N C K S S Q S I L N S S N N K N Y L A W Y Q Q K P G Q
P P K L L I Y W A S T R E S G V P D R F S G S G S G T D F T L T I S S L Q A
E D V A V Y Y C Q Q Y Y S S P P T F G Q G T K V E I K R
```

SEQ ID NO: 236
```
caggtccagc tggtgcagtc tggagctgag gtgaagaagc ctgggtcctc ggtgaaggtc    60
tcctgcaagg cttctggagt caccttcagt tactatgcta tgagctgggt gcgacaggcc   120
cctggacaag ggcttgagtg gatgggagga atcagcccta tgtttgggac aacaacctac   180
gcacagaagt tccagggcag agtcacgatt actgcggacg actccacgag tacagcctac   240
atggaggtga ggagcctgag atctgaggac acggccgtgt attactgtgc agatcttcg   300
aattactatg atagtgtata tgactactgg ggccagggaa ccctggtcac cgtctcgagc   360
ggtacgggcg gttcaggcgg aaccggcagc ggcactggcg gtcgacgca gtctgtcgtg   420
acgcagccgc cctcggagtc agtggcccca ggacagacgg ccaggattac ctgtggggga   480
cataacattg gaagtaatag tgtgcactgg taccagcaga agccaggcca ggcccctgtg   540
ctggtcgtgt atgataatag cgaccggccc tcagggatcc ctgagcgatt ctctggctcc   600
```

```
aactctggga acacggccac cctgaccatc agcagggtcg aagccgggga tgaggccgac    660
tattactgtc aggtgtgggg tagtagtagt gaccattatg tcttcggaac tgggaccaag    720
gtcaccgtcc taggt                                                    735
```

SEQ ID NO: 237
Q V Q L V Q S G A E V K K P G S S V K V S C K A S G V T F S Y Y A M S W V R
Q A P G Q G L E W M G G I S P M F G T T T Y A Q K F Q G R V T I T A D D S T
S T A Y M E V R S L R S E D T A V Y Y C A R S S N Y Y D S V Y D Y W G Q G T
L V T V S S G T G G S G G T G S G T G G S T Q S V V T Q P P S E S V A P G Q
T A R I T C G G H N I G S N S V H W Y Q Q K P G Q A P V L V V Y D N S D R P
S G I P E R F S G S N S G N T A T L T I S R V E A G D E A D Y Y C Q V W G S
S S D H Y V F G T G T K V T V L G

SEQ ID NO: 316
```
gaggtccagc tggtgcagtc tggggctgag gtgaagaagc ctggggcctc agtgaaggtc     60
tcctgcaagg cttctgggta caccttcacc ggctactatg tgtactgggt gcgacaggcc    120
cctggacaag gcttgagtg gatgggatgg atcagcgctt acaatggtaa cacaaactat    180
gcacagaagt tccagggcag agtcacgatt accgcggaca aatccacgag cacagcctac    240
atggagctga gcagcctgag atctgaagac acggctgtgt attactgtgc gagaagtaga    300
tccctggacg tctggggcca agggaccacg gtcaccgtct cgagtgctag caccaagggc    360
ccagcgtgt tccccctggc cccagcagc aagagcacca gcggcggcac agccgccctg    420
ggctgcctgg tgaaggacta cttccccgag cccgtgaccg tgagctggaa cagcggcgcc    480
ttgaccagcg gcgtgcacac cttccccgcc gtgctgcaga gcagcggcct gtacagcctg    540
agcagcgtgg tgaccgtgcc agcagcagc ctgggcaccc agacctacat ctgcaacgtg    600
aaccacaagc ccagcaacac caaggtggac aaacgcgtgg agcccaagag ctgcgacaag    660
acccacacct gccccccctg ccctgccccc gagctgctgg gcggaccctc cgtgttcctg    720
ttccccccca gcccaagga caccctcatg atcagccgga cccccgaggt gacctgcgtg    780
gtggtggacg tgagccacga ggaccccgag gtgaagttca actggtacgt ggacggcgtg    840
gaggtgcaca acgccaagac caagccccgg gaggagcagt acaacagcac ctaccgggtg    900
gtgagcgtgc tcaccgtgct gcaccaggac tggctgaacg gcaaggagta caagtgcaag    960
gtgagcaaca aggccctgcc tgcccccatc gagaagacca tcagcaaggc caagggccag   1020
ccccgggagc cccaggtgta caccctgccc ccagccgggg aggagatgac caagaaccag   1080
gtgtccctca cctgtctggt gaagggcttc taccccagcg acatcgccgt ggagtgggag   1140
agcaacggcc agcccgagaa caactacaag accacccccc ctgtgctgga cagcgacggc   1200
agcttcttcc tgtacagcaa gctcaccgtg gacaagagcc ggtggcagca gggcaacgtg   1260
ttcagctgca gcgtgatgca cgaggccctg cacaaccact acacccagaa gagcctgagc   1320
ctgagccccg gcaag                                                  1335
```

SEQ ID NO: 317
E V Q L V Q S G A E V K K P G A S V K V S C K A S G Y T F T G Y Y V Y W V R
Q A P G Q G L E W M G W I S A Y N G N T N Y A Q K F Q G R V T I T A D K S T
S T A Y M E L S S L R S E D T A V Y Y C A R S R L D V W G Q G T T V T V S
S A S T K G P S V F P L A P S S K S T S G G T A A L G C L V K D Y F P E P V
T V S W N S G A L T S G V H T F P A V L Q S S G L Y S L S S V V T V P S S S
L G T Q T Y I C N V N H K P S N T K V D K R V E P K S C D K T H T C P P C P

-continued

A P E L L G G P S V F L F P P K P K D T L M I S R T P E V T C V V V D V S H

E D P E V K F N W Y V D G V E V H N A K T K P R E E Q Y N S T Y R V V S V L

T V L H Q D W L N G K E Y K C K V S N K A L P A P I E K T I S K A K G Q P R

E P Q V Y T L P P S R E E M T K N Q V S L T C L V K G F Y P S D I A V E W E

S N G Q P E N N Y K T T P P V L D S D G S F F L Y S K L T V D K S R W Q Q G

N V F S C S V M H E A L H N H Y T Q K S L S L S P G K

SEQ ID NO: 318

```
gatgttgtga tgactcagtc tccagactcc ctggctgtgt ctctgggcga gagggccacc      60
atcaactgca agtccagcca gagtgtttta tacagctcca acaataagaa ctacttagct     120
tggtaccagc agaaaccagg acagcctcct aagctgctca tttactgggc atctacccgg     180
gaatccgggg tccctgaccg attcagtggc agcgggtctg ggacagattt cactctcacc     240
atcagcagcc tgcaggctga agatgtggca gtttattact gtcagcaata ttatagtact     300
cctctcactt tcggcggagg gaccaaagtg gatatcaaac gtgcggccgc acccagcgtg     360
ttcatcttcc cccctccga cgagcagctg aagagcggca ccgccagcgt ggtgtgcctg     420
ctgaacaact ctaccccccg ggaggccaag gtgcagtgga aggtggacaa cgccctgcag     480
agcggcaaca gccaggagag cgtgaccgag caggacagca aggactccac ctacagcctg     540
agcagcaccc tcaccctgag caaggccgac tacgagaagc acaaggtgta cgcctgcgag     600
gtgacccacc agggcctgag cagccccgtg accaagagct caaccgggg cgagtgt       657
```

SEQ ID NO: 319

D V V M T Q S P D S L A V S L G E R A T I N C K S S Q S V L Y S S N N K N Y

L A W Y Q Q K P G Q P P K L L I Y W A S T R E S G V P D R F S G S G S G T D

F T L T I S S L Q A E D V A V Y Y C Q Q Y Y S T P L T F G G G T K V D I K R

A A A P S V F I F P P S D E Q L K S G T A S V V C L L N N F Y P R E A K V Q

W K V D N A L Q S G N S Q E S V T E Q D S K D S T Y S L S S T L T L S K A D

Y E K H K V Y A C E V T H Q G L S S P V T K S F N R G E C

SEQ ID NO: 320

```
cagatgcagc tggtgcagtc tggggctgag gtgaagaagc ctgggtcctc ggtgaaggtc      60
tcctgcaagg cttctggagg caccttctcc agttatgcta tcacctgggt gcgacaggcc     120
cctggacaag gcttgagtg gatgggaggg atcatcggta tgtttggttc aacaaactac     180
gcacagaact tccagggcag agtcacgatt accgcggacg aatccacgag cacagcctac     240
atggagctga gcagcctcag atctgaggac acggccgtgt attactgtgc gagaagtact     300
ggttattacc ctgcatacct ccaccactgg ggccagggca ccctggtcac cgtctcgagt     360
gctagcacca agggccccag cgtgttcccc ctggccccca gcagcaagag caccagcggc     420
ggcacagccg ccctgggctg cctggtgaag gactacttcc ccgagcccgt gaccgtgagc     480
tggaacagcg gcgccttgac cagcggcgtg cacaccttcc ccgccgtgct gcagagcagc     540
ggcctgtaca gcctgagcag cgtggtgacc gtgcccagca gcagcctggg cacccagacc     600
tacatctgca acgtgaacca caagcccagc aacaccaagg tggacaaacg cgtggagccc     660
aagagctgcg acaagaccca cacctgcccc cctgccctg ccccgagct gctgggcgga     720
ccctccgtgt tcctgttccc cccaaagccc aaggacaccc tcatgatcag ccggaccccc     780
gaggtgacct gcgtggtggt ggacgtgagc cacgaggacc ccgaggtgaa gttcaactgg     840
tacgtggacg gcgtggaggt gcacaacgcc aagaccaagc ccgggagga gcagtacaac     900
agcacctacc gggtggtgag cgtgctcacc gtgctgcacc aggactggct gaacggcaag     960
```

-continued

```
gagtacaagt gcaaggtgag caacaaggcc ctgcctgccc ccatcgagaa gaccatcagc       1020
aaggccaagg gccagccccg ggagcccag gtgtacaccc tgccccccag ccggaggag         1080 atgaccaaga accaggtgtc cctcacctgt ctggtgaagg gcttctaccc cagcgacatc       1140
gccgtggagt gggagagcaa cggccagccc gagaacaact acaagaccac ccccctgtg       1200 ctggacagcg acggcagctt cttcctgtac agcaagctca ccgtggacaa gagccggtgg     1260
cagcagggca acgtgttcag ctgcagcgtg atgcacgagg ccctgcacaa ccactacacc     1320
cagaagagcc tgagcctgag ccccggcaag                                      1350
```

SEQ ID NO: 321

Q M Q L V Q S G A E V K K P G S S V K V S C K A S G G T F S S Y A I T W V R

Q A P G Q G L E W M G G I I G M F G S T N Y A Q N F Q G R V T I T A D E S T

S T A Y M E L S S L R S E D T A V Y Y C A R S T G Y Y P A Y L H H W G Q G T

L V T V S S A S T K G P S V F P L A P S S K S T S G G T A A L G C L V K D Y

F P E P V T V S W N S G A L T S G V H T F P A V L Q S S G L Y S L S S V V T

V P S S S L G T Q T Y I C N V N H K P S N T K V D K R V E P K S C D K T H T

C P P C P A P E L L G G P S V F L F P P K P K D T L M I S R T P E V T C V V

V D V S H E D P E V K F N W Y V D G V E V H N A K T K P R E E Q Y N S T Y R

V V S V L T V L H Q D W L N G K E Y K C K V S N K A L P A P I E K T I S K A

K G Q P R E P Q V Y T L P P S R E E M T K N Q V S L T C L V K G F Y P S D I

A V E W E S N G Q P E N N Y K T T P P V L D S D G S F F L Y S K L T V D K S

R W Q Q G N V F S C S V M H E A L H N H Y T Q K S L S L S P G K

SEQ ID NO: 322
```
cagtctgccc tgactcagcc tcgctcagtg tccgggtctc ctggacagtc agtcaccatc       60
tcctgcactg gaaccagcag tgatgttggt ggttataact atgtctcctg gtaccaacag     120
cacccaggca aagcccccaa actcatgatt tatgatgtca gtaagcggcc ctcaggggtc     180
cctgatcgct tctctggctc caagtctggc aacacggcct ccctgaccat ctctgggctc     240
caggctgagg atgaggctga ttattactgc agctcatata caagcagcag cactcatgtc     300
ttcggaactg ggaccaaggt caccgtccta ggtgcggccg caggccagcc caaggccgct     360
cccagcgtga ccctgttccc ccctcctcc gaggagctgc aggccaacaa ggccaccctg     420
gtgtgcctca tcagcgactt ctaccctggc gccgtgaccg tggcctggaa ggccgacagc     480
agccccgtga aggccggcgt ggagaccacc acccccagca gcagagcaa caacaagtac     540 gccgccagca gctacctgag cctcacccc gagcagtgga agagccaccg gagctacagc     600
tgccaggtga cccacgaggg cagcaccgtg gagaagaccg tggcccccac cgagtgcagc     660
```

SEQ ID NO: 323

Q S A L T Q P R S V S G S P G Q S V T I S C T G T S S D V G G Y N Y V S W Y

Q Q H P G K A P K L M I Y D V S K R P S G V P D R F S G S K S G N T A S L T

I S G L Q A E D E A D Y Y C S S Y T S S S T H V F G T G T K V T V L G A A A

G Q P K A A P S V T L F P P S S E E L Q A N K A T L V C L I S D F Y P G A V

T V A W K A D S S P V K A G V E T T T P S K Q S N N K Y A A S S Y L S L T P

E Q W K S H R S Y S C Q V T H E G S T V E K T V A P T E C S

SEQ ID NO: 324
```
gaggtgcagc tggtggagac cggggctgag gtgaagaagc ctggggcctc agtgaaggtt       60
tcctgcaagg catctggata caccttcacc agctactata tgcactgggt gcgacaggcc     120
cctggacaag gcttgagtg gatgggatgg atcaaccctA acagtggtgg cacaaactat     180
```

-continued

```
gcacagaagt tcagggcag ggtcaccatg accagggaca cgtccatcag cacagcctac      240
atggagctga gcaggctgag atctgacgac acggccgtgt attactgtgc gagagagggg      300
aaatggggac ctcaagcggc ttttgatatc tggggccaag ggacaatggt caccgtctcg      360
agtgctagca ccaagggccc cagcgtgttc cccctggccc cagcagcaa gagcaccagc       420 ggcggcacag ccgccctggg ctgcctggtg aaggactact ccccgagcc cgtgaccgtg       480 agctggaaca gcggcgcctt gaccagcggc gtgcacacct ccccgccgt gctgcagagc       540 agcggcctgt acagcctgag cagcgtggtg accgtgccca gcagcagcct gggcacccag      600
acctacatct gcaacgtgaa ccacaagccc agcaacacca aggtggacaa acgcgtggag      660
cccaagagct gcgacaagac ccacacctgc ccccctgcc ctgcccccga gctgctgggc       720 ggacccccg tgttcctgtt cccccccaag cccaaggaca ccctcatgat cagccggacc        780
cccgaggtga cctgcgtggt ggtggacgtg agccacgagg accccgaggt gaagttcaac       840
tggtacgtgg acggcgtgga ggtgcacaac gccaagacca gccccgggga ggagcagtac      900
aacagcacct accgggtggt gagcgtgctc accgtgctgc accaggactg gctgaacggc      960
aaggagtaca agtgcaaggt gagcaacaag gccctgcctg cccccatcga aagaccatc      1020 agcaaggcca agggccagcc ccgggagccc caggtgtaca ccctgccccc cagccgggag      1080
gagatgacca agaaccaggt gtccctcacc tgtctggtga agggcttcta ccccagcgac      1140
atcgccgtgg agtgggagag caacggccag cccgagaaca actacaagac cccccccct      1200 gtgctggaca gcgacggcag cttcttcctg tacagcaagc tcaccgtgga caagagccgg      1260
tggcagcagg gcaacgtgtt cagctgcagc gtgatgcacg aggccctgca caaccactac      1320
acccagaaga gcctgagcct gagccccggc aag                                   1353
```

SEQ ID NO: 325

E V Q L V E T G A E V K K P G A S V K V S C K A S G Y T F T S Y Y M H W V R

Q A P G Q G L E W M G W I N P N S G G T N Y A Q K F Q G R V T M T R D T S I

S T A Y M E L S R L R S D D T A V Y Y C A R E G K W G P Q A A F D I W G Q G

T M V T V S S A S T K G P S V F P L A P S S K S T S G G T A A L G C L V K D

Y F P E P V T V S W N S G A L T S G V H T F P A V L Q S S G L Y S L S S V V

T V P S S S L G T Q T Y I C N V N H K P S N T K V D K R V E P K S C D K T H

T C P P C P A P E L L G G P S V F L F P P K P K D T M I S R T P E V T C V

V V D V S H E D P E V K F N W Y V D G V E V H N A K T K P R E E Q Y N S T Y

R V V S V L T V L H Q D W L N G K E Y K C K V S N K A L P A P I E K T I S K

A K G Q P R E P Q V Y T L P P S R E E M T K N Q V S L T C L V K G F Y P S D

I A V E W E S N G Q P E N N Y K T T P P V L D S D G S F F L Y S K L T V D K

S R W Q Q G N V F S C S V M H E A L H N H Y T Q K S L S L S P G K

SEQ ID NO: 326

```
gaaattgtga tgacgcagtc tccaggcacc ctgtctttgt ctccagggga aagagccacc       60
ctctcctgca gggccagtca gagtgttagc agcagctact tagcctggta ccagcagaaa      120
cctggccagg ctcccaggct cctcatctat gatgcatcca gcagggccac tgacatccca      180
gacaggttca gtggcagtgg gtctgggaca gacttcactc tcaccatcag cagactggag      240
cctgaagatt ttgcagtgta ttactgtcag cagtatggta gctcactttg gacgttcggc      300
caagggacca aggtggagat caaacgtgcg gccgcaccca gcgtgttcat cttcccccc       360 tccgacgagc agctgaagag cggcaccgcc agcgtggtgt gcctgctgaa caacttctac      420
ccccgggagg ccaaggtgca gtggaaggtg gacaacgccc tgcagagcgg caacagccag      480
```

```
gagagcgtga ccgagcagga cagcaaggac tccacctaca gcctgagcag caccctcacc      540
ctgagcaagg ccgactacga gaagcacaag gtgtacgcct gcgaggtgac ccaccagggc      600
ctgagcagcc ccgtgaccaa gagcttcaac cggggcgagt gt                         642
```

SEQ ID NO: 327

```
E I V M T Q S P G T L S L S P G E R A T L S C R A S Q S V S S S Y L A W Y Q

Q K P G Q A P R L L I Y D A S S R A T D I P D R F S G S G S G T D F T L T I

S R L E P E D F A V Y Y C Q Q Y G S S L W T F G Q G T K V E I K R A A A P S

V F I F P P S D E Q L K S G T A S V V C L L N N F Y P R E A K V Q W K V D N

A L Q S G N S Q E S V T E Q D S K D S T Y S L S S T L T L S K A D Y E K H K

V Y A C E V T H Q G L S S P V T K S F N R G E C
```

SEQ ID NO: 328

```
gaggtgcagc tggtagagtc tgggggaggc ttggtacagc ctggggggtc cctgagactc       60
tcctgtgcag cctctggatt cacctttagc atctatgcca tgagctgggt ccgccaggca      120
ccagggaagg ggctggagtg gtctcagct attagtagta gtggtgatag cacatactac       180
gcagactccg tgaagggccg gttcaccatc tccagagaca acgccaggaa cacgctgtat      240
ctgcaaatga acagtctgag agccgaggac acggctgtgt attactgtgc gagagcgtat      300
ggctacacgt tcgacccctg gggccaggga accctggtca ccgtctcgag tgctagcacc      360
aagggcccca gcgtgttccc cctggccccc agcagcaaga gcaccagcgg cggcacagcc      420
gccctgggct gcctggtgaa ggactacttc cccgagcccg tgaccgtgag ctggaacagc      480
ggcgccttga ccagcggcgt gcacaccttc cccgccgtgc tgcagagcag cggcctgtac      540
agcctgagca gcgtggtgac cgtgcccagc agcagcctgg gcacccagac ctacatctgc      600
aacgtgaacc acaagcccag caacaccaag gtggacaaac gcgtggagcc caagagctgc      660
gacaagaccc acacctgccc ccctgccct gccccgagc tgctgggcgg accctccgtg       720
ttcctgttcc cccccaagcc caaggacacc ctcatgatca gccggacccc cgaggtgacc      780
tgcgtggtgg tggacgtgag ccacgaggac cccgaggtga agttcaactg gtacgtggac      840
ggcgtggagg tgcacaacgc caagaccaag ccccgggagg agcagtacaa cagcacctac      900
cgggtggtga gcgtgctcac cgtgctgcac caggactggc tgaacggcaa ggagtacaag      960
tgcaaggtga gcaacaaggc cctgcctgcc cccatcgaga agaccatcag caaggccaag     1020
ggccagcccc gggagcccca ggtgtacacc ctgcccccca gccgggagga gatgaccaag     1080
aaccaggtgt ccctcacctg tctggtgaag ggcttctacc ccagcgacat cgccgtggag     1140
tgggagagca acggccagcc cgagaacaac tacaagacca cccccccctgt gctggacagc     1200 gacggcagct tcttcctgta cagcaagctc accgtggaca gagccggtg gcagcagggc     1260 aacgtgttca gctgcagcgt gatgcacgag gccctgcaca accactacac ccagaagagc     1320
ctgagcctga gccccggcaa g                                               1341
```

SEQ ID NO: 329

```
E V Q L V E S G G G L V Q P G G S L R L S C A A S G F T F S I Y A M S W V R

Q A P G K G L E W V S A I S S S G D S T Y Y A D S V K G R F T I S R D N A R

N T L Y L Q M N S L R A E D T A V Y Y C A R A Y G Y T F D P W G Q G T L V T

V S S A S T K G P S V F P L A P S S K S T S G G T A A L G C L V K D Y F P E

P V T V S W N S G A L T S G V H T F P A V L Q S S G L Y S L S S V V T V P S

S S L G T Q T Y I C N V N H K F S N T K V D K R V E P K S C D K T H T C P P

C P A P E L L G G P S V F L F P P K P K D T L M I S R T P E V T C V V V D V
```

S H E D P E V K F N W Y V D G V E V H N A K T K P R E E Q Y N S T Y R V V S

V L T V L H Q D W L N G K E Y K C K V S N K A L P A P I E K T I S K A K G Q

P R E P Q V Y T L P P S R E E M T K N Q V S L T C L V K G F Y P S D I A V E

W E S N G Q P E N N Y K T T P P V L D S D G S F F L Y S K L T V D K S R W Q

Q G N V F S C S V M H E A L H N H Y T Q K S L S L S P G K

SEQ ID NO: 330

| | | |
|---|---|---|
| gaaattgtgc tgactcagtc tccactctcc ctgcccgtca cccctggaga gccggcctcc | 60 |
| atctcctgca ggtctagtca gagcctcctg catagtaatg gatacaacta tttggattgg | 120 |
| tacctgcaga agccagggca gtctccacag ctcctgatct atttgggttc taatcgggcc | 180 |
| tccggggtcc ctgacaggtt cagtggcagt ggatcaggca cagattttac actgaaaatc | 240 |
| agcagagtgg aggctgagga tgttggggtt tattactgca tgcaagctct acaaactccc | 300 |
| ctcactttcg gcggagggac caaggtggag atcaaacgtg cggccgcacc cagcgtgttc | 360 |
| atcttccccc cctccgacga gcagctgaag agcggcaccg ccagcgtggt gtgcctgctg | 420 |
| aacaacttct accccgggga ggccaaggtg cagtggaagg tggacaacgc cctgcagagc | 480 |
| ggcaacagcc aggagagcgt gaccgagcag gacagcaagg actccaccta cagcctgagc | 540 |
| agcaccctca ccctgagcaa ggccgactac gagaagcaca aggtgtacgc ctgcgaggtg | 600 |
| acccaccagg gcctgagcag ccccgtgacc aagagcttca accggggcga gtgt | 654 |

SEQ ID NO: 331

E I V L T Q S P L S L P V T P G E P A S I S C R S S Q S L L H S N G Y N Y L

D W Y L Q K P G Q S P Q L L I Y L G S N R A S G V P D R F S G S G S G T D F

T L K I S R V E A E D V G V Y Y C M Q A L Q T P L T F G G G T K V E I K R A

A A P S V F I F P P S D E Q L K S G T A S V V C L L N N F Y P R E A K V Q W

K V D N A L Q S G N S Q E S V T E Q D S K D S T Y S L S S T L T L S K A D Y

E K H K V Y A C E V T H Q G L S S P V T K S F N R G E C

SEQ ID NO: 332

| | | |
|---|---|---|
| gaggtgcagc tggtggagac cggggctgag gtgaagaagc ctgggtcctc ggtgaaggtc | 60 |
| tcctgcaagg cctctggagg caccttcagg acccatgcta tcagttgggt gcgacaggcc | 120 |
| cctggacaag gcttgagtg gatgggaggg atcatcgcta tcttcggaac agcaaactac | 180 |
| gcacagaagt tccagggcag aatcacgatt accgcggacg aatccacgag tacagcctac | 240 |
| atggagctga gcagcctgag atctgaggac acggccgtgt atttctgtgc gagaggcagt | 300 |
| ggttatcata tatcgacacc ctttgacaac tggggccagg gaaccctggt caccgtctcg | 360 |
| agtgctagca ccaagggccc cagcgtgttc cccctggccc ccagcagcaa gagcaccagc | 420 |
| ggcggcacag ccgccctggg ctgcctggtg aaggactact cccccgagcc cgtgaccgtg | 480 |
| agctggaaca gcggcgcctt gaccagcggc gtgcacacct tccccgccgt gctgcagagc | 540 |
| agcggcctgt acagcctgag cagcgtggtg accgtgccca gcagcagcct gggcacccag | 600 |
| acctacatct gcaacgtgaa ccacaagccc agcaacacca aggtggacaa gcgtggag | 660 |
| cccaagagct gcgacaagac ccacacctgc cccccctgcc ctgccccga gctgctgggc | 720 |
| ggaccctccg tgttcctgtt cccccccaag cccaaggaca ccctcatgat cagccggacc | 780 |
| cccgaggtga cctgcgtggt ggtggacgtg agccacgagg accccgaggt gaagttcaac | 840 |
| tggtacgtgg acggcgtgga ggtgcacaac gccaagacca gcccccgggg ggagcagtac | 900 |
| aacagcacct accgggtggt gagcgtgctc accgtgctgc accaggactg gctgaacggc | 960 |
| aaggagtaca agtgcaaggt gagcaacaag gccctgcctg cccccatcga gaagaccatc | 1020 |

-continued

```
agcaaggcca agggccagcc ccgggagccc caggtgtaca ccctgccccc cagccgggag      1080
gagatgacca agaaccaggt gtccctcacc tgtctggtga agggcttcta ccccagcgac      1140
atcgccgtgg agtgggagag caacggccag cccgagaaca actacaagac cacccccct      1200 gtgctggaca cgacggcag cttcttcctg tacagcaagc tcaccgtgga caagagccgg      1260
tggcagcagg gcaacgtgtt cagctgcagc gtgatgcacg aggccctgca caaccactac      1320
acccagaaga gcctgagcct gagccccggc aag                                   1353
```

SEQ ID NO: 333

E V Q L V E T G A E V K K P G S S V K V S C K A S G G T F R T H A I S W V R

Q A P G Q G L E W M G G I I A I F G T A N Y A Q K F Q G R I T I T A D E S T

S T A Y M E L S S L R S E D T A V Y F C A R G S G Y H I S T P F D N W G Q G

T L V T V S S A S T K G P S V F P L A P S S K S T S G G T A A L G C L V K D

Y F P E P V T V S W N S G A L T S G V H T F P A V L Q S S G L Y S L S S V V

T V P S S S L G T Q T Y I C N V N H K P S N T K V D K R V E P K S C D K T H

T C P P C P A P E L L G G P S V F L F P P K P K D T L M I S R T P E V T C V

V V D V S H E D P E V K F N W Y V D G V E V H N A K T K P R E E Q Y N S T Y

R V V S V L T V L H Q D W L N G K E Y K C K V S N K A L P A P I E K T I S K

A K G Q P R E P Q V Y T L P P S R E E M T K N Q V S L T C L V K G F Y P S D

I A V E W E S N G Q P E N N Y K T T P P V L D S D G S F F L Y S K L T V D K

S R W Q Q G N V F S C S V M H E A L H N H Y T Q K S L S L S P G K

SEQ ID NO: 334

```
tcctatgtgc tgactcagcc accctcggtg tcagtggccc caggacagac ggccaggatt       60
acctgtgggg gaaacaacat tggaagtaaa ggtgtgcact ggtaccagca gaagcctggc      120
caggcccctg tgctggtcgt ctatgatgat agcgaccggc cctcagggat ccctgagcga      180
ttctctggct ccaactctgg gaacacggcc accctgacca tcagcagggt cgaagccggg      240
gatgaggccg actattactg tcaggtgtgg gatagtagta gtgatcatgt ggtattcggc      300
ggagggacca gcctgaccgt cctaggtgcg gccgcaggcc agcccaaggc cgctcccagc      360
gtgaccctgt tccccccctc ctccgaggag ctgcaggcca acaaggccac cctggtgtgc      420
ctcatcagcg acttctaccc tggcgccgtg accgtggcct ggaaggccga cagcagcccc      480
gtgaaggccg gcgtggagac caccaccccc agcaagcaga gcaacaacaa gtacgccgcc      540
agcagctacc tgagcctcac ccccgagcag tggaagagcc accggagcta cagctgccag      600
gtgacccacg agggcagcac cgtggagaag accgtggccc ccaccgagtg cagc            654
```

SEQ ID NO: 335

S Y V L T Q P P S V S V A P G Q T A R I T C G G N N I G S K G V H W Y Q Q K

P G Q A P V L V V Y D D S D R P S G I P E R F S G S N S G N T A T L T I S R

V E A G D E A D Y Y C Q V W D S S S D H V V F G G G T K L T V L G A A A G Q

P K A A P S V T L F P P S S E E L Q A N K A T L V C L I S D F Y P G A V T V

A W K A D S S P V K A G V E T T T P S K Q S N N K Y A A S S Y L S L T P E Q

W K S H R S Y S C Q V T H E G S T V E K T V A P T E C S

SEQ ID NO: 336

```
gaggtgcagc tggtggagtc tggggctgag gtgaagaagc ctgggtcctc ggtgaaggtc       60
tcctgcaagg cttctggaca catcttcagc ggctatgcaa tcagttgggt gcgacaggcc      120
cctggacaag gccttgagtg gatgggaggg atcatcccta tctttggtac aacaaactac      180
gcacagaagt tccagggcag agtcacgatt accgcggacc aatccacgag cacagcctac      240
```

-continued

```
atggacctga gcaacttgag atctgaggac acggccgtct attactgtgc gagagtgaaa      300
gatggatatt gtactcttac cagctgccct gtcggctggt acttcgatct ctggggccgt      360
ggcaccctgg tcactgtctc gagtgctagc accaagggcc cagcgtgtt ccccctggcc       420 cccagcagca agagcaccag cggcggcaca gccgccctgg gctgcctggt gaaggactac      480
ttccccgagc ccgtgaccgt gagctggaac agcggcgcct tgaccagcgg cgtgcacacc      540
ttccccgccg tgctgcagag cagcggcctg tacagcctga gcagcgtggt gaccgtgccc      600
agcagcagcc tgggcaccca gacctacatc tgcaacgtga accacaagcc cagcaacacc      660
aaggtggaca acgcgtgga gcccaagagc tgcgacaaga cccacacctg cccccccctgc     720 cctgcccccg agctgctggg cggacccccc gtgttcctgt tccccccaa gcccaaggac      780 accctcatga tcagccggac ccccgaggtg acctgcgtgg tggtggacgt gagccacgag      840
gaccccgagg tgaagttcaa ctggtacgtg gacggcgtgg aggtgcacaa cgccaagacc      900 aagcccgg aggagcagta caacagcacc taccgggtgg tgagcgtgct caccgtgctg       960
caccaggact ggctgaacgg caaggagtac aagtgcaagg tgagcaacaa ggccctgcct    1020
gcccccatcg agaagaccat cagcaaggcc aagggccagc ccgggagcc ccaggtgtac   1080 accctgcccc cagccggga ggagatgacc aagaaccagg tgtccctcac ctgtctggtg    1140
aagggcttct accccagcga catcgccgtg gagtgggaga gcaacggcca gcccgagaac    1200
aactacaaga ccaccccccc tgtgctggac agcgacggca gcttcttcct gtacagcaag    1260
ctcaccgtgg acaagagccg gtggcagcag ggcaacgtgt tcagctgcag cgtgatgcac    1320
gaggccctgc acaaccacta cacccagaag agcctgagcc tgagccccgg caag          1374
```

SEQ ID NO: 337

E V Q L V E S G A E V K K P G S S V K V S C K A S G H I F S G Y A I S W V R
Q A P G Q G L E W M G G I I P I F G T T N Y A Q K F Q G R V T I T A D Q S T
S T A Y M D L S N L R S E D T A V Y Y C A R V K D G Y C T L T S C P V G W Y
F D L W G R G T L V T V S S A S T K G P S V F P L A P S S K S T S G G T A A
L G C L V K D Y F P E P V T V S W N S G A L T S G V H T F P A V L Q S S G L
Y S L S S V V T V P S S S L G T Q T Y I C N V N H K P S N T K V D K R V E P
K S C D K T H T C P P C P A P E L L G G P S V F L F P P K P K D T L M I S R
T P E V T C V V V D V S H E D P E V K F N W Y V D G V E V H N A K T K P R E
E Q Y N S T Y R V V S V L T V L H Q D W L N G K E Y K C K V S N K A L P A P
I E K T I S K A K G Q P R E P Q V Y T L P P S R E E M T K N Q V S L T C L V
K G F Y P S D I A V E W E S N G Q P E N N Y K T T P P V L D S D G S F F L Y
S K L T V D K S R W Q Q G N V F S C S V M H E A L H N H Y T Q K S L S L S P
G K

SEQ ID NO: 338

```
gaaattgtga tgacgcagtc tccaggcacc ctgtctttgt ctccagggga aagagccacc       60
ctctcgtgca gggccagtca gagtgttagc agcagctact tagcctggta ccagcagaaa     120
cctggccagg ctcccaggct cctcatcttt ggtgcctcca gcagggccac tggcatccca     180
gacaggttca gtggcagtgg gtctgggaca gacttcactc tcaccatcag cagactggag     240
cctgaagatt ttgcagtgta ttactgtcag cagtatggta gctcactcac tttcggcgga    300
gggaccaagc tggagatcaa acgtgcggcc gcacccagcg tgttcatctt ccccccctcc    360
gacgagcagc tgaagagcgg caccgccagc gtggtgtgcc tgctgaacaa cttctacccc    420
cgggaggcca aggtgcagtg gaaggtggac aacgccctgc agagcggcaa cagccaggag    480
```

```
agcgtgaccg agcaggacag caaggactcc acctacagcc tgagcagcac cctcaccctg    540
agcaaggccg actacgagaa gcacaaggtg tacgcctgcg aggtgaccca ccagggcctg    600
agcagccccg tgaccaagag cttcaaccgg ggcgagtgt                          639
```

SEQ ID NO: 339

```
E I V M T Q S P G T L S L S P G E R A T L S C R A S Q S V S S S Y L A W Y Q

Q K P G Q A P R L L I F G A S S R A T G I P D R F S G S G S G T D F T L T I

S R L E P E D F A V Y Y C Q Q Y G S S L T F G G G T K L E I K R A A P S V

F I F P P S D E Q L K S G T A S V V C L L N N F Y P R E A K V Q W K V D N A

L Q S G N S Q E S V T E Q D S K D S T Y S L S S T L T L S K A D Y E K H K V

Y A C E V T H Q G L S S P V T K S F N R G E C
```

SEQ ID NO: 340

```
gaggtccagc tggtacagtc tggggctgag gttaagaagc ctgggtcctc ggtgaaggtc     60
tcctgcaagg cttctggagg catcttcaga agcaattcta tcagttgggt gcgacaggcc    120
cctgggcaag gcttgagtg gatggagggg atcttcgctc ttttcggaac aacagactac    180
gcgcagaagt tccagggcag agtcacgatt accgcggacg aatcttcgac cacagtctac    240
ctggagctga gtagcctgac atctgaggac acggccgttt attactgtgc gagaggcagt    300
ggctacacca cacgcaacta ctttgactac tggggccagg gcaccctggt caccgtctcg    360
agtgctagca ccaagggccc cagcgtgttc cccctggccc ccagcagcaa gagcaccagc    420
ggcggcacag ccgccctggg ctgcctggtg aaggactact cccccgagcc cgtgaccgtg    480
agctggaaca gcggcgcctt gaccagcggc gtgcacacct tccccgccgt gctgcagagc    540
agcggcctgt acagcctgag cagcgtggtg accgtgccca gcagcagcct gggcacccag    600
acctacatct gcaacgtgaa ccacaagccc agcaacacca aggtggacaa gcgtgtggag    660
cccaagagct gcgacaagac ccacacctgc ccccctgcc ctgcccccga gctgctgggc    720
ggaccctccg tgttcctgtt cccccccaag cccaaggaca ccctcatgat cagccggacc    780
cccgaggtga cctgcgtggt ggtggacgtg agccacgagg accccgaggt gaagttcaac    840
tggtacgtgg acggcgtgga ggtgcacaac gccaagacca gcccggga ggagcagtac    900 aacagcacct accgggtggt gagcgtgctc accgtgctgc accaggactg gctgaacggc    960
aaggagtaca agtgcaaggt gagcaacaag gccctgcctg cccccatcga aaagaccatc   1020
agcaaggcca agggccagcc ccgggagccc caggtgtaca ccctgccccc cagccgggag   1080
gagatgacca gaaccaggt gtccctcacc tgtctggtga agggcttcta ccccagcgac   1140
atcgccgtgg agtgggagag caacggccag cccgagaaca actacaagac caccccccct   1200
gtgctggaca gcgacggcag cttcttcctg tacagcaagc tcaccgtgga caagagccgg   1260
tggcagcagg gcaacgtgtt cagctgcagc gtgatgcacg aggccctgca caaccactac   1320
acccagaaga gcctgagcct gagccccggc aag                                1353
```

SEQ ID NO: 341

```
E V Q L V Q S G A E V K K P G S S V K V S C K A S G G I F R S N S I S W V R

Q A P G Q G L E W M G G I F A L F G T T D Y A Q K F Q G R V T I T A D E S S

T T V Y L E L S S L T S E D T A V Y Y C A R G S G Y T T R N Y F D Y W G Q G

T L V T V S S A S T K G P S V F P L A P S S K S T S G G T A A L G C L V K D

Y F P E P V T V S W N S G A L T S G V H T F P A V L Q S S G L Y S L S S V V

T V P S S S L G T Q T Y I C N V N H K P S N T K V D K R V E P K S C D K T H

T C P P C P A P E L L G G P S V F L F P P K P K D T L M I S R T P E V T C V
```

-continued

V V D V S H E D P E V K F N W Y V D G V E V H N A K T K P R E E Q Y N S T Y

R V V S V L T V L H Q D W L N G K E Y K C K V S N K A L P A P I E K T I S K

A K G Q P R E P Q V Y T L P P S R E E M T K N Q V S L T C L V K G F Y P S D

I A V E W E S N G Q P E N N Y K T T P P V L D S D G S F F L Y S K L T V D K

S R W Q Q G N V F S C S V M H E A L H N H Y T Q K S L S L S P G K

SEQ ID NO: 342
```
gaaattgtgc tgactcagtc tccaggcacc ctgtctttgt ctccagggga aagagccaca        60
ctctcctgca gggccagtca gagtgttagc agcaactact taggctggta ccagcagaaa       120
cctggccagg ctcccaggct cctgatctat ggtgcatcca gcagggccag tggcatccca       180
gacaggttca gtggcggtgg gtctgggaca gacttcactc tcaccatcag cagactggag       240
cctgaagatt ttgcagtgta ttactgtcag cagtatggta gctcacccct cactttcggc       300
ggagggacca aggtggagat caaacgtgcg gccgcaggcc agcccaaggc cgctcccagc       360
gtgaccctgt tccccccctc ctccgaggag ctgcaggcca acaaggccac cctggtgtgc       420
ctcatcagcg acttctaccc tggcgccgtg accgtggcct ggaaggccga cagcagcccc       480
gtgaaggccg gcgtggagac caccacccc agcaagcaga gcaacaacaa gtacgccgcc       540
agcagctacc tgagcctcac ccccgagcag tggaagagcc accggagcta cagctgccag       600
gtgacccacg agggcagcac cgtggagaag accgtggccc ccaccgagtg cagc             654
```
SEQ ID NO: 343
E I V L T Q S P G T L S L S P G E R A T L S C R A S Q S V S S N Y L G W Y Q

Q K P G Q A P R L L I Y G A S S R A S G I P D R F S G G G S T D F T L T I

S R L E P E D F A V Y Y C Q Q Y G S S P L T F G G G T K V E I K R A A A G Q

P K A A P S V T L F P P S S E E L Q A N K A T L V C L I S D F Y P G A V T V

A W K A D S S P V K A G V E T T T P S K Q S N N K Y A A S S Y L S L T P E Q

W K S H R S Y S C Q V T H E G S T V E K T V A P T E C S

SEQ ID NO: 344
```
caggtgcagc tggtgcagtc tggggctgag gtgaagaagc ctgggtcctc ggtaaaggtc        60
tcctgcaagg cttctggagg ccccttccgc aattttgcta tcaactgggt gcgacaggcc       120
cctggacaag gcttgagtg gatgggaggg atcatcgctg tctttgggac gacaaagtac       180
gcacataagt tccagggcag agtcaccatc accgcggacg actccacaaa tacagcttac       240
atggagctgg gcagcctgaa atctgaggac acggccgtgt attactgtgc gagaggtccc       300
cactactact cctcctacat ggacgtctgg ggcgaaggga ccacggtcac cgtctcgagt       360
gctagcacca agggcccag cgtgttcccc ctggccccca gcagcaagag caccagcggc       420
ggcacagccg ccctgggctg cctggtgaag gactacttcc ccgagcccgt gaccgtgagc       480
tggaacagcg gcgccttgac cagcggcgtg cacaccttcc ccgccgtgct gcagagcagc       540
ggcctgtaca gcctgagcag cgtggtgacc gtgcccagca gcagcctggg cacccagacc       600
tacatctgca acgtgaacca caagcccagc aacaccaagg tggacaaacg cgtggagccc       660
aagagctgcg acaagaccca cacctgcccc cctgccctg ccccgagct gctgggcgga       720
ccctccgtgt tcctgttccc ccccaagccc aaggacaccc tcatgatcag ccggacccc       780
gaggtgacct gcgtggtggt ggacgtgagc cacgaggacc ccgaggtgaa gttcaactgg       840
tacgtggacg gcgtggaggt gcacaacgcc aagaccaagc ccggagga gcagtacaac       900
agcacctacc gggtggtgag cgtgctcacc gtgctgcacc aggactggct gaacggcaag       960
gagtacaagt gcaaggtgag caacaaggcc ctgcctgccc ccatcgagaa gaccatcagc      1020
```

-continued

```
aaggccaagg gccagccccg ggagcccag gtgtacaccc tgccccccag ccgggaggag      1080
atgaccaaga accaggtgtc cctcacctgt ctggtgaagg gcttctaccc cagcgacatc      1140
gccgtggagt gggagagcaa cggccagccc gagaacaact acaagaccac ccccctgtg       1200 ctggacagcg acggcagctt cttcctgtac agcaagctca ccgtggacaa gagccggtgg      1260
cagcagggca acgtgttcag ctgcagcgtg atgcacgagg ccctgcacaa ccactacacc      1320
cagaagagcc tgagcctgag ccccggcaag                                       1350
```

SEQ ID NO: 345

Q V Q L V Q S G A E V K K P G S S V K V S C K A S G G P F R N F A I N W V R
Q A P G Q G L E W M G G I I A V F G T T K Y A H K F Q G R V T I T A D D S T
N T A Y M E L G S L K S E D T A V Y Y C A R G P H Y Y S S Y M D V W G E G T
T V T V S S A S T K G P S V F P L A P S S K S T S G G T A A L G C L V K D Y
F P E P V T V S W N S G A L T S G V H T F P A V L Q S S G L Y S L S S V V T
V P S S S L G T Q T Y I C N V N H K P S N T K V D K R V E P K S C D K T H T
C P P C P A P E L L G G P S V F L F P P K P K D T L M I S R T P E V T C V V
V D V S H E D P E V K F N W Y V D G V E V H N A K T K P R E E Q Y N S T Y R
V V S V L T V L H Q D W L N G K E Y K C K V S N K A L P A P I E K T I S K A
K G Q P R E P Q V Y T L P P S R E E M T K N Q V S L T C L V K G F Y P S D I
A V E W E S N G Q P E N N Y K T T P P V L D S D G S F F L Y S K L T V D K S
R W Q Q G N V F S C S V M H E A L H N H Y T Q K S L S L S P G K

SEQ ID NO: 346

```
gacatccagt tgacccagtc tccatcctcc ctgtctgcat ctgtaggaga cagagtcacc      60
atcacttgcc gggcgagtca gggcattagc acttatttag cctggtatca gcagaaaccc     120
gggaaagttc ctaaactcct gatctatgct gcatccactt tgcaatcagg ggtcccatct     180
cggttcagtg gcagtggatc tgggacagat ttcactctca ccatcagcag cctgcagcct     240
gaagatgttg caacttatta ctgtcaaaag tataacagtg cccccttcttt cggccctggg   300 accaaagtgg atatcaaacg tgcggccgca cccagcgtgt tcatcttccc ccctccgac      360 gagcagctga agagcggcac cgccagcgtg gtgtgcctgc tgaacaactt ctaccccgg      420 gaggccaagg tgcagtggaa ggtggacaac gccctgcaga gcggcaacag ccaggagagc     480
gtgaccgagc aggacagcaa ggactccacc tacagcctga gcagcaccct caccctgagc    540
aaggccgact acgagaagca caaggtgtac gcctgcgagg tgacccacca gggcctgagc    600
agccccgtga ccaagagctt caaccggggc gagtgt                              636
```

SEQ ID NO: 347

D I Q L T Q S P S S L S A S V G D R V T I T C R A S Q G I S T Y L A W Y Q Q
K P G K V P K L L I Y A A S T L Q S G V P S R F S G S G S G T D F T L T I S
S L Q P E D V A T Y Y C Q K Y N S A P S F G P G T K V D I K R A A A P S V F
I F P P S D E Q L K S G T A S V V C L L N N F Y P R E A K V Q W K V D N A L
Q S G N S Q E S V T E Q D S K D S T Y S L S S T L T L S K A D Y E K H K V Y
A C E V T H Q G L S S P V T K S F N R G E C

SEQ ID NO: 348

```
gaggtgcagc tggtggagac tggggctgag gtgaagaagc ctgggtcctc ggtgaaggtc      60
ccctgcaaat cttctggaag cccctttcagg agtaatgctg tcagctgggt gcgacaggcc    120
cccggacaag gcttgagtg gatgggagga atcctcggtg tctttggttc accaagctac     180
gcacagaagt tccagggcag agtcacgatt accgcggacg aatccaccaa cacagtccac     240
```

-continued

```
atggagctga gaggtttgag atctgaggac acggccgtgt attattgtgc gagaggtcct      300
acctactact actcctacat ggacgtctgg ggcaaaggga ccacggtcac cgtctcgagt      360
gctagcacca agggcccag cgtgttcccc ctggccccca gcagcaagag caccagcggc       420
ggcacagccg ccctgggctg cctggtgaag gactacttcc ccgagcccgt gaccgtgagc      480
tggaacagcg gcgccttgac cagcggcgtg cacaccttcc ccgccgtgct gcagagcagc      540
ggcctgtaca gcctgagcag cgtggtgacc gtgcccagca gcagcctggg cacccagacc      600
tacatctgca acgtgaacca caagcccagc aacaccaagg tggacaaacg cgtggagccc      660
aagagctgcg acaagaccca cacctgcccc cctgccctg ccccgagct gctgggcgga        720
ccctccgtgt tcctgttccc ccccaagccc aaggacaccc tcatgatcag ccggacccc       780
gaggtgacct gcgtggtggt ggacgtgagc cacgaggacc ccgaggtgaa gttcaactgg      840
tacgtggacg gcgtggaggt gcacaacgcc aagaccaagc ccgggagga gcagtacaac      900
agcacctacc gggtggtgag cgtgctcacc gtgctgcacc aggactggct gaacggcaag      960
gagtacaagt gcaaggtgag caacaaggcc ctgcctgccc ccatcgagaa gaccatcagc     1020
aaggccaagg gccagccccg ggagcccag gtgtacaccc tgcccccag ccgggaggag       1080
atgaccaaga accaggtgtc cctcacctgt ctggtgaagg gcttctaccc cagcgacatc     1140
gccgtggagt gggagagcaa cggccagccc gagaacaact acaagaccac ccccctgtg      1200
ctggacagcg acggcagctt cttcctgtac agcaagctca ccgtggacaa gagccggtgg     1260
cagcagggca acgtgttcag ctgcagcgtg atgcacgagg ccctgcacaa ccactacacc     1320
cagaagagcc tgagcctgag ccccggcaag                                      1350
```

```
                                                        SEQ ID NO: 349
E V Q L V E T G A E V K K P G S S V K V P C K S S G S P F R S N A V S W V R
Q A P G Q G L E W V G G I L G V F G S P S Y A Q K F Q G R V T I T A D E S T
N T V H M E L R G L R S E D T A V Y Y C A R G P T Y Y Y S Y M D V W G K G T
T V T V S S A S T K G P S V F P L A P S S K S T S G G T A A L G C L V K D Y
F P E P V T V S W N S G A L T S G V H T F P A V L Q S S G L Y S L S S V V T
V P S S S L G T Q T Y I C N V N H K P S N T K V D K R V E P K S C D K T H T
C P P C P A P E L L G G P S V F L P P K P K D T L M I S R T P E V T C V V
V D V S H E D P E V K F N W Y V D G V E V H N A K T K P R E E Q Y N S T Y R
V V S V L T V L H Q D W L N G K E Y K C K V S N K A L P A P I E K T I S K A
K G Q P R E P Q V Y T L P P S R E E M T K N Q V S L T C L V K G F Y P S D I
A V E W E S N G Q P E N N Y K T T P P V L D S D G S F F L Y S K L T V D K S
R W Q Q G N V F S C S V M H E A L H N H Y T Q K S L S L S P G K
```

```
                                                        SEQ ID NO: 350
tcctatgtgc tgactcagcc acccctcgag tcagtggccc caggacagac ggccaggatt       60
acctgtgggg gaaataacat tggaagaaat agtgtgcact ggtatcagca gaagccaggc      120
caggccctg tgctggtcgt gtatgatgat agcgaccggc cctcagggat ccctgagcga       180
tttttctggct ccaagtctgg gaacacggcc accctgatta tcagcagggt cgaagtcggg     240
gatgaggccg actactactg tcaggtgtgg catagtagta gtgatcatta tgtcttcgga      300
actgggacca aggtcaccgt cctaggtgcg gccgcaggcc agcccaaggc cgctcccagc      360
gtgaccctgt tcccccctc ctccgaggag ctgcaggcca acaaggccac cctggtgtgc      420
ctcatcagca cttctacccc tggcgccgtg accgtggcct ggaaggccga cagcagcccc     480
gtgaaggccg gcgtggagac caccaccccc agcaagcaga gcaacaacaa gtacgccgcc     540
```

-continued

```
agcagctacc tgagcctcac ccccgagcag tggaagagcc accggagcta cagctgccag      600
gtgacccacg agggcagcac cgtggagaag accgtggccc ccaccgagtg cagc            654
```

SEQ ID NO: 351

S Y V L T Q P P S E S V A P G Q T A R I T C G G N N I G R N S V H W Y Q Q K

P G Q A P V L V V Y D D S D R P S G I P E R F S G S K S G N T A T L I I S R

V E V G D E A D Y Y C Q V W H S S S D H Y V F G T G T K V T V L G A A A G Q

P K A A P S V T L F P P S S E E L Q A N K A T L V C L I S D F Y P G A V T V

A W K A D S S P V K A G V E T T T P S K Q S N N K Y A A S S Y L S L T P E Q

W K S H R S Y S C Q V T H E G S T V E K T V A P T E C S

SEQ ID NO: 352

```
cagatgcagc tggtacaatc tggagctgag gtgaagaagc ctgggtcctc ggtgaaggtc       60
tcctgcaagg cttctggagg caccttcagc agctatgcta tcagctgggt gcgacaggcc      120
cctggacaag gcttgagtg gatgggaggg atcttcggta tgtttgggac agcaaactac      180
gcgcagaagt tccagggcag agtcacgatt accgcggacg aattcacgag cgcggcctac      240
atggagctga gcagcctggg atctgaggac acggccatgt attactgtgc gaggtctagt      300
ggttattacc cccaatactt ccaggactgg ggccagggca ccctggtcac cgtctcgagt      360
gctagcacca agggcccag cgtgttcccc ctggcccca gcagcaagag caccagcggc      420
ggcacagccg ccctgggctg cctggtgaag gactacttcc ccgagcccgt gaccgtgagc      480
tggaacagcg gcgccttgac cagcggcgtg cacaccttcc ccgccgtgct gcagagcagc      540
ggcctgtaca gcctgagcag cgtggtgacc gtgcccagca gcagcctggg cacccagacc      600
tacatctgca acgtgaacca caagcccagc aacaccaagg tggacaaacg cgtggagccc      660
aagagctgcg acaagaccca cacctgcccc cctgccctg ccccgagct gctgggcgga      720 ccctccgtgt tcctgttccc cccaagccc aaggacaccc tcatgatcag ccggacccc      780 gaggtgacct gcgtggtggt ggacgtgagc acgaggacc ccgaggtgaa gttcaactgg      840
tacgtggacg gcgtggaggt gcacaacgcc aagaccaagc ccgggagga gcagtacaac      900 agcacctacc gggtggtgag cgtgctcacc gtgctgcacc aggactggct gaacggcaag      960
gagtacaagt gcaaggtgag caacaaggcc ctgcctgccc ccatcgagaa gaccatcagc     1020
aaggccaagg gccagccccg ggagcccag gtgtacaccc tgccccccag ccggaggag      1080 atgaccaaga accaggtgtc cctcacctgt ctggtgaagg gcttctaccc cagcgacatc     1140
gccgtggagt gggagagcaa cggccagccc gagaacaact acaagaccac cccccctgtg     1200
ctggacagcg acggcagctt cttcctgtac agcaagctca ccgtggacaa gagccggtgg     1260
cagcagggca acgtgttcag ctgcagcgtg atgcacgagg ccctgcacaa ccactacacc     1320
cagaagagcc tgagcctgag ccccggcaag                                      1350
```

SEQ ID NO: 353

Q M Q L V Q S G A E V K K P G S S V K V S C K A S G G T F S S Y A I S W V R

Q A P G Q G L E W M G G I F G M F G T A N Y A Q K F Q G R V T I T A D E F T

S A A Y M E L S S L G S E D T A M Y Y C A R S S G Y Y P Q Y F Q D W G Q G T

L V T V S S A S T K G P S V F P L A P S S K S T S G G T A A L G C L V K D Y

F P E P V T V S W N S G A L T S G V H T F P A V L Q S S G L Y S L S S V V T

V P S S S L G T Q T Y I C N V N H K P S N T K V D K R V E P K S C D K T H T

C P P C P A P E L L G G P S V F L F P P K P K D T L M I S R T P E V T C V V

V D V S H E D P E V K F N W Y V D G V E V H N A K T K P R E E Q Y N S T Y R

-continued

V V S V L T V L H Q D W L N G K E Y K C K V S N K A L P A P I E K T I S K A

K G Q P R E P Q V Y T L P P S R E E M T K N Q V S L T C L V K G F Y P S D I

A V E W E S N G Q P E N N Y K T T P P V L D S D G S F F L Y S K L T V D K S

R W Q Q G N V F S C S V M H E A L H N H Y T Q K S L S L S P G K

SEQ ID NO: 354

| | | | | |
|---|---|---|---|---|
| gaaattgtga | tgacacagtc | tccaggcacc | ctgtctttgt | ctccagggca | aagagccacc | 60 |
| ctctcctgca | gggccagtca | gagtgttagc | agcagctact | tagcctggta | ccagcagaaa | 120 |
| cctggccagg | ctcccagact | cctcatgtat | ggtgcatcca | gcagggccac | tggcatccca | 180 |
| gacaggttca | gtggcagtgg | gtctgggaca | gacttcactc | tcaccatcag | cagactggag | 240 |
| cctgaagatt | ttgcagtgta | ttactgtcag | cagtatggta | gctcatcgct | cactttcggc | 300 |
| ggagggacca | agctggagat | caaacgtgcg | gccgcaccca | gcgtgttcat | cttcccccc | 360 |
| tccgacgagc | agctgaagag | cggcaccgcc | agcgtggtgt | gcctgctgaa | caacttctac | 420 |
| ccccgggagg | ccaaggtgca | gtggaaggtg | gacaacgccc | tgcagagcgg | caacagccag | 480 |
| gagagcgtga | ccgagcagga | cagcaaggac | tccacctaca | gcctgagcag | caccctcacc | 540 |
| ctgagcaagg | ccgactacga | gaagcacaag | gtgtacgcct | gcgaggtgac | ccaccagggc | 600 |
| ctgagcagcc | ccgtgaccaa | gagcttcaac | cggggcgagt | gt | | 642 |

SEQ ID NO: 355

E I V M T Q S P G T L S L S P G Q R A T L S C R A S Q S V S S S Y L A W Y Q

Q K P G Q A P R L L M Y G A S S R A T G I P D R F S G S G S G T D F T L T I

S R L E P E D F A V Y Y C Q Q Y G S S S L T F G G G T K L E I K R A A A P S

V F I F P P S D E Q L K S G T A S V V C L L N N F Y P R E A K V Q W K V D N

A L Q S G N S Q E S V T E Q D S K D S T Y S L S S T L T L S K A D Y E K H K

V Y A C E V T H Q G L S S P V T K S F N R G E C

SEQ ID NO: 356

| | | | | |
|---|---|---|---|---|
| gaggtgcagc | tggtggagtc | cggggctgag | gtgaagaagc | ctgggtcctc | ggtgaaggtc | 60 |
| tcctgcaagg | cttctggagg | catcttcaac | agttatgcta | tcagctgggt | gcgacaggcc | 120 |
| cctggacaag | ggcttgagtg | gatgggaggc | atcatcgcta | tctttcatac | accaaagtac | 180 |
| gcacagaagt | tccagggcag | agtcacgatt | accgcggacg | aatccacgaa | cacagcctac | 240 |
| atggaactga | gaagcctgaa | atctgaggac | acggccctgt | attactgtgc | gagagggtcc | 300 |
| acttacgatt | tttcgagtgg | ccttgactac | tggggccagg | gaaccctggt | caccgtctcg | 360 |
| agtgctagca | ccaagggccc | cagcgtgttc | cccctggccc | ccagcagcaa | gagcaccagc | 420 |
| ggcggcacag | ccgccctggg | ctgcctggtg | aaggactact | tccccgagcc | cgtgaccgtg | 480 |
| agctggaaca | gcgcgccctt | gaccagcggc | gtgcacacct | tccccgccgt | gctgcagagc | 540 |
| agcggcctgt | acagcctgag | cagcgtggtg | accgtgccca | gcagcagcct | gggcacccag | 600 |
| acctacatct | gcaacgtgaa | ccacaagccc | agcaacacca | aggtggacaa | gcgcgtggag | 660 |
| cccaagagct | gcgacaagac | ccacacctgc | cccccctgcc | ctgcccccga | gctgctgggc | 720 |
| ggaccctccg | tgttcctgtt | ccccccaag | cccaaggaca | cctcatgat | cagccggacc | 780 |
| cccgaggtga | cctgcgtggt | ggtggacgtg | agccacgagg | accccgaggt | gaagttcaac | 840 |
| tggtacgtgg | acggcgtgga | ggtgcacaac | gccaagacca | agccccggga | ggagcagtac | 900 |
| aacagcacct | accgggtggt | gagcgtgctc | accgtgctgc | accaggactg | gctgaacggc | 960 |
| aaggagtaca | agtgcaaggt | gagcaacaag | gccctgcctg | cccccatcga | gaagaccatc | 1020 |
| agcaaggcca | agggccagcc | ccgggagccc | caggtgtaca | ccctgccccc | cagccgggag | 1080 |

-continued

```
gagatgacca agaaccaggt gtccctcacc tgtctggtga agggcttcta ccccagcgac      1140
atcgccgtgg agtgggagag caacggccag cccgagaaca actacaagac cacccccct       1200
gtgctggaca gcgacggcag cttcttcctg tacagcaagc tcaccgtgga caagagccgg      1260
tggcagcagg gcaacgtgtt cagctgcagc gtgatgcacg aggccctgca caaccactac      1320
acccagaaga gcctgagcct gagccccggc aag                                   1353
```

SEQ ID NO: 357

```
E V Q L V E S G A E V K K P G S S V K V S C K A S G G I F N S Y A I S W V R
Q A P G Q G L E W M G G I I A I F H T P K Y A Q K F Q G R V T I T A D E S T
N T A Y M E L R S L K S E D T A L Y Y C A R G S T Y D F S S G L D Y W G Q G
T L V T V S S A S T K G P S V F P L A P S S K S T S G G T A A L G C L V K D
Y F P E P V T V S W N S G A L T S G V H T F P A V L Q S S G L Y S L S S V V
T V P S S S L G T Q T Y I C N V N H K P S N T K V D K R V E P K S C D K T H
T C P P C P A P E L L G G P S V F L F P P K P K D T L M I S R T P E V T C V
V V D V S H E D P E V K F N W Y V D G V E V H N A K T K P R E E Q Y N S T Y
R V V S V L T V L H Q D W L N G K E Y K C K V S N K A L P A P I E K T I S K
A K G Q P R E P Q V Y T L P P S R E E M T K N Q V S L T C L V K G F Y P S D
I A V E W E S N G Q P E N N Y K T T P P V L D S D G S F F L Y S K L T V D K
S R W Q Q G N V F S C S V M H E A L H N H Y T Q K S L S L S P G K
```

SEQ ID NO: 358

```
caggcagggc tgactcagcc accctcggtg tcagtggccc caggacagac ggccaggatt       60
acctgtgggg gaaacaacat tggaagtaaa agtgtgcact ggtaccagca gaagccaggc      120
caggcccctg tcctagtcgt ctatgatgat agcgaccggc cctcagggat ccctgagcga      180
ttctctggct ccaactctgg gaacacggcc accctgacca tcagcagggt cgaagccggg      240
gatgaggccg actattactg tcaggtgtgg gatagtagta gtgatcatgt ggtattcggc      300
ggagggacca agctgaccgt cctaggtgcg gccgcaggcc agcccaaggc cgctcccagc      360
gtgaccctgt tcccccctc ctccgaggag ctgcaggcca caaggccac cctggtgtgc       420
ctcatcagcg acttctaccc tggcgccgtg accgtggcct ggaaggccga cagcagcccc      480
gtgaaggccg gcgtggagac caccacccc agcaagcaga gcaacaacaa gtacgccgcc      540
agcagctacc tgagcctcac ccccgagcag tggaagagcc accggagcta cagctgccag      600
gtgacccacg agggcagcac cgtggagaag accgtggccc ccaccgagtg cagc            654
```

SEQ ID NO: 359

```
Q A G L T Q P P S V S V A P G Q T A R I T C G G N N I G S K S V H W Y Q Q K
P G Q A P V L V V Y D D S D R P S G I P E R F S G S N S G N T A T L T I S R
V E A G D E A D Y Y C Q V W D S S S D H V V F G G G T K L T V L G A A A G Q
P K A A P S V T L F P P S S E E L Q A N K A T L V C L I S D F Y P G A V T V
A W K A D S S P V K A G V E T T T P S K Q S N N K Y A A S S Y L S L T P E Q
W K S H R S Y S C Q V T H E G S T V E K T V A P T E C S
```

SEQ ID NO: 360

```
caggtccagc tggtgcagtc tggggctgag gtgaagaagc ctgggtcctc ggtgaaggtc       60
tcctgcaagg cttctggagg cttcttcagc agctatgcta tcagctgggt gcgcaggcc      120
cctggacaag gacttgagtg gatggggggg gtcatcccta tctttcgtac agcaaactac      180
gcacagaact tccagggcag agtcaccatt accgcggacg aattcacatc gtatatggag      240
ctgagcagcc tgagatctga cgacacggcc gtgtattact gtgcgaggtt gaattaccat      300
```

-continued

```
gattcgggga cttattataa cgccccccgg ggctggttcg accccctgggg ccagggaacc    360 ctggtcaccg tctcgagtgc tagcaccaag ggccccagcg tgttcccct  ggccccagc     420 agcaagagca ccagcggcgg cacagccgcc ctgggctgcc tggtgaagga ctacttcccc    480
gagcccgtga ccgtgagctg gaacagcggc gccttgacca gcggcgtgca caccttcccc    540
gccgtgctgc agagcagcgg cctgtacagc ctgagcagcg tggtgaccgt gcccagcagc    600
agcctgggca cccagaccta catctgcaac gtgaaccaca agcccagcaa caccaaggtg    660
gacaaacgcg tggagcccaa gagctgcgac aagacccaca cctgcccccc ctgccctgcc    720
cccgagctgc tgggcggacc ctccgtgttc ctgttccccc ccaagcccaa ggacaccctc    780
atgatcagcc ggaccccga  ggtgacctgc gtggtggtgg acgtgagcca cgaggacccc    840
gaggtgaagt tcaactggta cgtggacggc gtggaggtgc acaacgccaa gaccaagccc    900
cgggaggagc agtacaacag cacctaccgg gtggtgagcg tgctcaccgt gctgcaccag    960
gactggctga acggcaagga gtacaagtgc aaggtgagca caaggccct  gcctgccccc   1020 atcgagaaga ccatcagcaa ggccaagggc cagccccggg agccccaggt gtacaccctg   1080
ccccccagcc gggaggagat gaccaagaac caggtgtccc tcacctgtct ggtgaagggc   1140
ttctacccca cgacatcgc  cgtggagtgg gagagcaacg gccagcccga gaacaactac   1200
aagaccaccc cccctgtgct ggacagcgac ggcagcttct tcctgtacag caagctcacc   1260
gtggacaaga gccggtggca gcagggcaac gtgttcagct gcagcgtgat gcacgaggcc   1320
ctgcacaacc actacaccca gaagagcctg agcctgagcc ccggcaag              1368
```

SEQ ID NO: 361

```
Q V Q L V Q S G A E V K K P G S S V K V S C K A S G G F F S S Y A I S W V R

Q A P G Q G L E W M G G V I P I F R T A N Y A Q N F Q G R V T I T A D E F T

S Y M E L S S L R S D D T A V Y Y C A R L N Y H D S G T Y Y N A P R G W F D

P W G Q G T L V T V S S A S T K G P S V F P L A P S S K S T S G G T A A L G

C L V K D Y F P E P V T V S W N S G A L T S G V H T F P A V L Q S S G L Y S

L S S V V T V P S S S L G T Q T Y I C N V N H K P S N T K V D K R V E P K S

C D K T H T C P P C P A P E L L G G P S V F L F P P K P K D T L M I S R T P

E V T C V V V D V S H E D P E V K F N W Y V D G V E V H N A K T K P R E E Q

Y N S T Y R V V S V L T V L H Q D W L N G K E Y K C K V S N K A L P A P I E

K T I S K A K G Q P R E P Q V Y T L P P S R E E M T K N Q V S L T C L V K G

F Y P S D I A V E W E S N G Q P E N N Y K T T P P V L D S D G S F F L Y S K

L T V D K S R W Q Q G N V F S C S V M H E A L H N H Y T Q K S L S L S P G K
```

SEQ ID NO: 362

```
gacatccaga tgacccagtc tccagactcc ctggctgtgt ctctgggcga aaggccacc     60 atcaactgca gtccagcca  gagtatttta aacagctcca acaataagaa ctacttagct    120
tggtaccagc agaaaccagg acagcctcct aagctgctca tttactgggc atctacccgg    180
gaatccgggg tccctgaccg attcagtggc agcgggtctg ggacagattt cactctcacc    240
atcagcagcc tgcaggctga agatgtggca gtttattact gtcagcaata ttatagtagt    300
ccgccgacgt tcggccaagg gaccaaggtg gaaatcaaac gtgcggccgc acccagcgtg    360
ttcatcttcc cccctccga  cgagcagctg aagagcggca ccgccagcgt ggtgtgcctg    420
ctgaacaact tctaccccg  ggaggccaag gtgcagtgga aggtggacaa cgccctgcag    480
agcggcaaca gccaggagag cgtgaccgag caggacagca aggactccac ctacagcctg    540
```

-continued

```
agcagcaccc tcaccctgag caaggccgac tacgagaagc acaaggtgta cgcctgcgag      600
gtgacccacc agggcctgag cagccccgtg accaagagct caaccggggg cgagtgt         657
```

SEQ ID NO: 363

```
D I Q M T Q S P D S L A V S L G E K A T I N C K S S Q S I L N S S N N K N Y
L A W Y Q Q K P G Q P P K L L I Y W A S T R E S G V P D R F S G S G S G T D
F T L T I S S L Q A E D V A V Y Y C Q Q Y Y S S P P T F G Q G T K V E I K R
A A A P S V F I F P P S D E Q L K S G T A S V V C L L N N F Y P R E A K V Q
W K V D N A L Q S G N S Q E S V T E Q D S K D S T Y S L S S T L T L S K A D
Y E K H K V Y A C E V T H Q G L S S P V T K S F N R G E C
```

SEQ ID NO: 364

```
caggtccagc tggtgcagtc tggagctgag gtgaagaagc ctgggtcctc ggtgaaggtc       60
tcctgcaagg cttctggagt caccttcagt tactatgcta tgagctgggt gcgacaggcc     120
cctggacaag gcttgagtg gatgggagga atcagcccta tgtttgggac aacaacctac      180
gcacagaagt tccagggcag agtcacgatt actgcggacg actccacgag atacagccta     240
cgatggaggtga ggagcctgag atctgaggac acggccgtgt attactgtgc gagatcttcg   300
aattactatg atagtgtata tgactactgg ggccagggaa ccctggtcac cgtctcgagt     360
gctagcacca agggcccag cgtgttcccc ctggcccca gcagcaagag caccagcggc       420
ggcacagccg ccctgggctg cctggtgaag gactacttcc ccgagcccgt gaccgtgagc     480
tggaacagcg gcgccttgac cagcggcgtg cacaccttcc ccgccgtgct gcagagcagc     540
ggcctgtaca gcctgagcag cgtggtgacc gtgcccagca gcagcctggg cacccagacc     600
tacatctgca acgtgaacca caagcccagc aacaccaagg tggacaaacg cgtggagccc     660
aagagctgcg acaagaccca cacctgcccc cctgccctg cccccgagct gctgggcgga     720
cccctccgtgt tcctgttccc ccccaagccc aaggacaccc tcatgatcag ccggaccccc    780
gaggtgacct gcgtggtggt ggacgtgagc cacgaggacc ccgaggtgaa gttcaactgg    840
tacgtggacg gcgtggaggt gcacaacgcc aagaccaagc ccgggagga gcagtacaac    900
agcacctacc gggtggtgag cgtgctcacc gtgctgcacc aggactggct gaacggcaag   960
gagtacaagt gcaaggtgag caacaaggcc ctgcctgccc ccatcgagaa gaccatcagc    1020
aaggccaagg gccagccccg ggagccccag gtgtacaccc tgcccccag ccgggaggag    1080
atgaccaaga accaggtgtc cctcacctgt ctggtgaagg gcttctaccc cagcgacatc     1140
gccgtggagt gggagagcaa cggccagccc gagaacaact acaagaccac ccccctgtg    1200
ctggacagcg acggcagctt cttcctgtac agcaagctca ccgtggacaa gagccggtgg   1260
cagcagggca acgtgttcag ctgcagcgtg atgcacgagg ccctgcacaa ccactacacc   1320
cagaagagcc tgagcctgag ccccggcaag                                     1350
```

SEQ ID NO: 365

```
Q V Q L V Q S G A E V K K P G S S V K V S C K A S G V T F S Y Y A M S W V R
Q A P G Q G L E W M G G I S P M F G T T T Y A Q K F Q G R V T I T A D D S T
S T A Y M E V R S L R S E D T A V Y Y C A R S S N Y Y D S V Y D Y W G Q G T
L V T V S S A S T K G P S V F P L A P S S K S T S G G T A A L G C L V K D Y
F P E P V T V S W N S G A L T S G V H T F P A V L Q S S G L Y S L S S V V T
V P S S S L G T Q T Y I C N V N H K P S N T K V D K R V E P K S C D K T H T
C P P C P A P E L L G G P S V F L F P P K P K D T L M I S R T P E V T C V V
V D V S H E D P E V K F N W Y V D G V E V H N A K T K P R E E Q Y N S T Y R
```

-continued
V V S V L T V L H Q D W L N G K E Y K C K V S N K A L P A P I E K T I S K A

K G Q P R E P Q V Y T L P P S R E E M T K N Q V S L T C L V K G F Y P S D I

A V E W E S N G Q P E N N Y K T T P P V L D S D G S F F L Y S K L T V D K S

R W Q Q G N V F S C S V M H E A L H N H Y T Q K S L S L S P G K

SEQ ID NO: 366

```
cagtctgtcg tgacgcagcc gccctcggag tcagtggccc caggacagac ggccaggatt    60
acctgtgggg gacataacat tggaagtaat agtgtgcact ggtaccagca gaagccaggc   120
caggcccctg tgctggtcgt gtatgataat agcgaccggc cctcagggat ccctgagcga   180
ttctctggct ccaactctgg gaacacggcc accctgacca tcagcagggt cgaagccggg   240
gatgaggccg actattactg tcaggtgtgg ggtagtagta gtgaccatta tgtcttcgga   300
actgggacca aggtcaccgt cctaggtgcg gccgcaggcc agcccaaggc cgctcccagc   360
gtgaccctgt tccccccctc ctccgaggag ctgcaggcca acaaggccac cctggtgtgc   420
ctcatcagcg acttctaccc tggcgccgtg accgtggcct ggaaggccga cagcagcccc   480
gtgaaggccg gcgtggagac caccaccccc agcaagcaga gcaacaacaa gtacgccgcc   540
agcagctacc tgagcctcac ccccgagcag tggaagagcc accggagcta cagctgccag   600
gtgacccacg agggcagcac cgtggagaag accgtggccc ccaccgagtg cagc         654
```

SEQ ID NO: 367

Q S V V T Q P P S E S V A P G Q T A R I T C G G H N I G S N S V H W Y Q Q K

P G Q A P V L V V Y D N S D R P S G I P E R F S G S N S G N T A T L T I S R

V E A G D E A D Y Y C Q V W G S S S D H Y V F G T G T K V T V L G A A A G Q

P K A A P S V T L F P P S S E E L Q A N K A T L V C L I S D F Y P G A V T V

A W K A D S S P V K A G V E T T T P S K Q S N N K Y A A S S Y L S L T P E Q

W K S H R S Y S C Q V T H E G S T V E K T V A P T E C S

TABLE 1

First round Vkappa, Vlambda and VH amplifications

| Primer name | Primer nucleotide sequence | SEQ ID NO: |
|---|---|---|
| OK1 (HuVK1B) | GAC ATC CAG WTG ACC CAG TCT CC | 144 |
| OK2 (HuVK2) | GAT GTT GTG ATG ACT CAG TCT CC | 145 |
| OK3 (HuVK2B2) | GAT ATT GTG ATG ACC CAG ACT CC | 146 |
| OK4 (HuVK3B) | GAA ATT GTG WTG ACR CAG TCT CC | 147 |
| OK5 (HuVK5) | GAA ACG ACA CTC ACG CAG TCT CC | 148 |
| OK6 (HuVK6) | GAA ATT GTG CTG ACT CAG TCT CC | 149 |
| OCK (HuCK) | ACA CTC TCC CCT GTT GAA GCT CTT | 150 |
| OL1 (HuVL1A)* | CAG TCT GTG CTG ACT CAG CCA CC | 151 |
| OL1 (HuVL1B)* | CAG TCT GTG YTG ACG CAG CCG CC | 152 |
| OL1 (HuVL1C)* | CAG TCT GTC GTG ACG CAG CCG CC | 153 |
| OL2 (HuVL2B) | CAG TCT GCC CTG ACT CAG CC | 154 |
| OL3 (HuVL3A) | TCC TAT GWG CTG ACT CAG CCA CC | 155 |
| OL4 (HuVL3B) | TCT TCT GAG CTG ACT CAG GAC CC | 156 |
| OL5 (HuVL4B) | CAG CYT GTG CTG ACT CAA TC | 157 |
| OL6 (HuVL5) | CAG GCT GTG CTG ACT CAG CCG TC | 158 |
| OL7 (HuVL6) | AAT TTT ATG CTG ACT CAG CCC CA | 159 |
| OL8 (HuVL7/8) | CAG RCT GTG GTG ACY CAG GAG CC | 160 |
| OL9 (HuVL9)# | CWG CCT GTG CTG ACT CAG CCM CC | 161 |
| OL9 (HuVL10)# | CAG GCA GGG CTG ACT CAG | 162 |
| OCL (HuCL2)X | TGA ACA TTC TGT AGG GGC CAC TG | 163 |
| OCL (HuCL7)X | AGA GCA TTC TGC AGG GGC CAC TG | 164 |
| OH1 (HuVH1B7A)+ | CAG RTG CAG CTG GTG CAR TCT GG | 165 |
| OH1 (HuVH1C)+ | SAG GTC CAG CTG GTR CAG TCT GG | 166 |
| OH2 (HuVH2B) | CAG RTC ACC TTG AAG GAG TCT GG | 167 |

TABLE 1-continued

First round Vkappa, Vlambda and VH amplifications

| Primer name | Primer nucleotide sequence | SEQ ID NO: |
|---|---|---|
| OH3 (HuVH3A) | GAG GTG CAG CTG GTG GAG | 168 |
| OH4 (HuVH3C) | GAG GTG CAG CTG GTG GAG WCY GG | 169 |
| OH5 (HuVH4B) | CAG GTG CAG CTA CAG CAG TGG GG | 170 |
| OH6 (HuVH4C) | CAG STG CAG CTG CAG GAG TCS GG | 171 |
| OH7 (HuVH6A) | CAG GTA CAG CTG CAG CAG TCA GG | 172 |
| OCM (HuCIgM) | TGG AAG AGG CAC GTT CTT TTC TTT | 173 |

*Mix in 1:1:1 ratio
Mix in 1:1 ratio
XMix in 1:1 ratio
+Mix in 1:1 ratio

TABLE 2

Second round Vkappa, Vlambda and VH amplifications

| Primer name | Primer nucleotide sequence | SEQ ID NO |
|---|---|---|
| OK1S (HuVK1B-SAL) | TGA GCA CAC AGG TCG ACG GAC ATC CAG WTG ACC CAG TCT CC | 174 |
| OK2S (HuVK2-SAL) | TGA GCA CAC AGG TCG ACG GAT GTT GTG ATG ACT CAG TCT CC | 175 |
| OK3S (HuVK2B2-SAL) | TGA GCA CAC AGG TCG ACG GAT ATT GTG ATG ACC CAG ACT CC | 176 |
| OK4S (HuVK3B-SAL) | TGA GCA CAC AGG TCG ACG GAA ATT GTG WTG ACR CAG TCT CC | 177 |
| OK5S (HuVK5-SAL) | TGA GCA CAC AGG TCG ACG GAA ACG ACA CTC ACG CAG TCT CC | 178 |
| OK6S (HuVK6-SAL) | TGA GCA CAC AGG TCG ACG GAA ATT GTG CTG ACT CAG TCT CC | 179 |
| OJK1 (HuJK1-NOT) | GAG TCA TTC TCG ACT TGC GGC CGC ACG TTT GAT TTC CAC CTT GGT CCC | 180 |
| OJK2 (HuJK2-NOT) | GAG TCA TTC TCG ACT TGC GGC CGC ACG TTT GAT CTC CAG CTT GGT CCC | 181 |
| OJK3 (HuJK3-NOT) | GAG TCA TTC TCG ACT TGC GGC CGC ACG TTT GAT ATC CAC TTT GGT CCC | 182 |
| OJK4 (HuJK4-NOT) | GAG TCA TTC TCG ACT TGC GGC CGC ACG TTT GAT CTC CAC CTT GGT CCC | 183 |
| OJK5 (HuJK5-NOT) | GAG TCA TTC TCG ACT TGC GGC CGC ACG TTT AAT CTC CAG TCG TGT CCC | 184 |
| OL1S (HuVL1A-SAL)* | TGA GCA CAC AGG TCG ACG CAG TCT GTG CTG ACT CAG CCA CC | 185 |
| OL1S (HuVL1B-SAL)* | TGA GCA CAC AGG TCG ACG CAG TCT GTG YTG ACG CAG CCG CC | 186 |
| OL1S (HuVL1C-SAL)* | TGA GCA CAC AGG TCG ACG CAG TCT GTC GTG ACG CAG CCG CC | 187 |
| OL2S (HuVL2B-SAL) | TGA GCA CAC AGG TCG ACG CAG TCT GCC CTG ACT CAG CC | 188 |
| OL3S (HuVL3A-SAL) | TGA GCA CAC AGG TCG ACG TCC TAT GWG CTG ACT CAG CCA CC | 189 |
| OL4S (HuVL3B-SAL) | TGA GCA CAC AGG TCG ACG TCT TCT GAG CTG ACT CAG GAC CC | 190 |
| OL5S (HuVL4B-SAL) | TGA GCA CAC AGG TCG ACG CAG CYT GTG CTG ACT CAA TC | 191 |
| OL6S (HuVL5-SAL) | TGA GCA CAC AGG TCG ACG CAG GCT GTG CTG ACT CAG CCG TC | 192 |

TABLE 2-continued

Second round Vkappa, Vlambda and VH amplifications

| Primer name | Primer nucleotide sequence | SEQ ID NO |
|---|---|---|
| OL7S (HuVL6-SAL) | TGA GCA CAC AGG TCG ACG AAT TTT ATG CTG ACT CAG CCC CA | 193 |
| OL8S (HuVL7/8-SAL) | TGA GCA CAC AGG TCG ACG CAG RCT GTG GTG ACY CAG GAG CC | 194 |
| OL9S (HuVL9-SAL)# | TGA GCA CAC AGG TCG ACG CWG CCT GTG CTG ACT CAG CCM CC | 195 |
| OL9S (HuVL10-SAL)# | TGA GCA CAC AGG TCG ACG CAG GCA GGG CTG ACT CAG | 196 |
| OJL1 (HuJL1-NOT) | GAG TCA TTC TCG ACT TGC GGC CGC ACC TAG GAC GGT GAC CTT GGT CCC | 197 |
| OJL2 (HuJL2/3-NOT) | GAG TCA TTC TCG ACT TGC GGC CGC ACC TAG GAC GGT CAG CTT GGT CCC | 198 |
| OJL3 (HuJL7-NOT) | GAG TCA TTC TCG ACT TGC GGC CGC ACC GAG GAC GGT CAG CTG GGT GCC | 199 |
| OH1S (HuVH1B-SFI)+ | GTC CTC GCA ACT GCG GCC CAG CCG GCC ATG GCC CAG RTG CAG CTG GTG CAR TCT GG | 200 |
| OH1S (HuVH1C-SFI)+ | GTC CTC GCA ACT GCG GCC CAG CCG GCC ATG GCC SAG GTC CAG CTG GTR CAG TCT GG | 201 |
| OH2S (HuVH2B-SFI) | GTC CTC GCA ACT GCG GCC CAG CCG GCC ATG GCC CAG RTC ACC TTG AAG GAG TCT GG | 202 |
| OH3S (HuVH3A-SFI) | GTC CTC GCA ACT GCG GCC CAG CCG GCC ATG GCC GAG GTG CAG CTG GTG GAG | 203 |
| OH4S (HuVH3C-SFI) | GTC CTC GCA ACT GCG GCC CAG CCG GCC ATG GCC GAG GTG CAG CTG GTG GAG WCY GG | 204 |
| OH5S (HuVH4B-SFI) | GTC CTC GCA ACT GCG GCC CAG CCG GCC ATG GCC CAG GTG CAG CTA CAG CAG TGG GG | 205 |
| OH6S (HuVH4C-SFI) | GTC CTC GCA ACT GCG GCC CAG CCG GCC ATG GCC CAG STG CAG CTG CAG GAG TCS GG | 206 |
| OH7S (HuVH6A-SFI) | GTC CTC GCA ACT GCG GCC CAG CCG GCC ATG GCC CAG GTA CAG CTG CAG CAG TCA GG | 207 |
| OJH1 (HuJH1/2-XHO) | GAG TCA TTC TCG ACT CGA GAC RGT GAC CAG GGT GCC | 208 |
| OJH2 (HuJH3-XHO) | GAG TCA TTC TCG ACT CGA GAC GGT GAC CAT TGT CCC | 209 |
| OJH3 (HuJH4/5-XHO) | GAG TCA TTC TCG ACT CGA GAC GGT GAC CAG GGT TCC | 210 |
| OJH4 (HuJH6-XHO) | GAG TCA TTC TCG ACT CGA GAC GGT GAC CGT GGT CCC | 211 |

*Mix in 1:1:1 ratio
Mix in 1:1 ratio
+Mix in 1:1 ratio

TABLE 3

Second round VL regions amplification overview

| Template | 5' primer | 3' primer | Product | Share in PK/PL (%) | Pool | Share in VL (%) |
|---|---|---|---|---|---|---|
| K1 | OK1S | OJK1 | K1J1 | 25 | PK1 | 30 |
|  | OK1S | OJK2 | K1J2 | 25 |  |  |
|  | OK1S | OJK3 | K1J3 | 10 |  |  |
|  | OK1S | OJK4 | K1J4 | 25 |  |  |
|  | OK1S | OJK5 | K1J5 | 15 |  |  |
| K2 | OK2S | OJK1 | K2J1 | 25 | PK2 | 4 |
|  | OK2S | OJK2 | K2J2 | 25 |  |  |
|  | OK2S | OJK3 | K2J3 | 10 |  |  |
|  | OK2S | OJK4 | K2J4 | 25 |  |  |
|  | OK2S | OJK5 | K2J5 | 15 |  |  |

TABLE 3-continued

Second round VL regions amplification overview

| Template | 5' primer | 3' primer | Product | Share in PK/PL (%) | Pool | Share in VL (%) |
|---|---|---|---|---|---|---|
| K3 | OK3S | OJK1 | K3J1 | 25 | PK3 | 1 |
|  | OK3S | OJK2 | K3J2 | 25 |  |  |
|  | OK3S | OJK3 | K3J3 | 10 |  |  |
|  | OK3S | OJK4 | K3J4 | 25 |  |  |
|  | OK3S | OJK5 | K3J5 | 15 |  |  |
| K4 | OK4S | OJK1 | K4J1 | 25 | PK4 | 19 |
|  | OK4S | OJK2 | K4J2 | 25 |  |  |
|  | OK4S | OJK3 | K4J3 | 10 |  |  |
|  | OK4S | OJK4 | K4J4 | 25 |  |  |
|  | OK4S | OJK5 | K4J5 | 15 |  |  |
| K5 | OK5S | OJK1 | K5J1 | 25 | PK5 | 1 |
|  | OK5S | OJK2 | K5J2 | 25 |  |  |
|  | OK5S | OJK3 | K5J3 | 10 |  |  |
|  | OK5S | OJK4 | K5J4 | 25 |  |  |
|  | OK5S | OJK5 | K5J5 | 15 |  |  |
| K6 | OK6S | OJK1 | K6J1 | 25 | PK6 | 5 |
|  | OK6S | OJK2 | K6J2 | 25 |  |  |
|  | OK6S | OJK3 | K6J3 | 10 |  |  |
|  | OK6S | OJK4 | K6J4 | 25 |  |  |
|  | OK6S | OJK5 | K6J5 | 15 |  |  |
| L1 | OL1S | OJL1 | L1J1 | 30 | PL1 | 14 |
|  | OL1S | OJL2 | L1J2 | 60 |  |  |
|  | OL1S | OJL3 | L1J3 | 10 |  |  |
| L2 | OL2S | OJL1 | L2J1 | 30 | PL2 | 10 |
|  | OL2S | OJL2 | L2J2 | 60 |  |  |
|  | OL2S | OJL3 | L2J3 | 10 |  |  |
| L3 | OL3S | OJL1 | L3J1 | 30 | PL3 | 10 |
|  | OL3S | OJL2 | L3J2 | 60 |  |  |
|  | OL3S | OJL3 | L3J3 | 10 |  |  |
| L4 | OL4S | OJL1 | L4J1 | 30 | PL4 | 1 |
|  | OL4S | OJL2 | L4J2 | 60 |  |  |
|  | OL4S | OJL3 | L4J3 | 10 |  |  |
| L5 | OL5S | OJL1 | L5J1 | 30 | PL5 | 1 |
|  | OL5S | OJL2 | L5J2 | 60 |  |  |
|  | OL5S | OJL3 | L5J3 | 10 |  |  |
| L6 | OL6S | OJL1 | L6J1 | 30 | PL6 | 1 |
|  | OL6S | OJL2 | L6J2 | 60 |  |  |
|  | OL6S | OJL3 | L6J3 | 10 |  |  |
| L7 | OL7S | OJL1 | L7J1 | 30 | PL7 | 1 |
|  | OL7S | OJL2 | L7J2 | 60 |  |  |
|  | OL7S | OJL3 | L7J3 | 10 |  |  |
| L8 | OL8S | OJL1 | L8J1 | 30 | PL8 | 1 |
|  | OL8S | OJL2 | L8J2 | 60 |  |  |
|  | OL8S | OJL3 | L8J3 | 10 |  |  |
| L9 | OL9S | OJL1 | L9J1 | 30 | PL9 | 1 |
|  | OL9S | OJL2 | L9J2 | 60 |  |  |
|  | OL9S | OJL3 | L9J3 | 10 |  |  |
|  |  |  |  |  | VL | 100% |

TABLE 4

Second round VH regions amplification overview

| Template | 5' primer | 3' primer | Product | Share in PK/PL (%) | Pool | Share in VH (%) |
|---|---|---|---|---|---|---|
| H1 | OH1S | OJH1 | H1J1 | 10 | PH1 | 25 |
|  | OH1S | OJH2 | H1J2 | 10 |  |  |
|  | OH1S | OJH3 | H1J3 | 60 |  |  |
|  | OH1S | OJH4 | H1J4 | 20 |  |  |
| H2 | OH2S | OJH1 | H2J1 | 10 | PH2 | 2 |
|  | OH2S | OJH2 | H2J2 | 10 |  |  |
|  | OH2S | OJH3 | H2J3 | 60 |  |  |
|  | OH2S | OJH4 | H2J4 | 20 |  |  |
| H3 | OH3S | OJH1 | H3J1 | 10 | PH3 | 25 |
|  | OH3S | OJH2 | H3J2 | 10 |  |  |
|  | OH3S | OJH3 | H3J3 | 60 |  |  |
|  | OH3S | OJH4 | H3J4 | 20 |  |  |
| H4 | OH4S | OJH1 | H4J1 | 10 | PH4 | 25 |
|  | OH4S | OJH2 | H4J2 | 10 |  |  |
|  | OH4S | OJH3 | H4J3 | 60 |  |  |
|  | OH4S | OJH4 | H4J4 | 20 |  |  |
| H5 | OH5S | OJH1 | H5J1 | 10 | PH5 | 2 |
|  | OH5S | OJH2 | H5J2 | 10 |  |  |
|  | OH5S | OJH3 | H5J3 | 60 |  |  |
|  | OH5S | OJH4 | H5J4 | 20 |  |  |
| H6 | OH6S | OJH1 | H6J1 | 10 | PH6 | 20 |
|  | OH6S | OJH2 | H6J2 | 10 |  |  |
|  | OH6S | OJH3 | H6J3 | 60 |  |  |
|  | OH6S | OJH4 | H6J4 | 20 |  |  |
| H7 | OH7S | OJH1 | H7J1 | 10 | PH7 | 1 |
|  | OH7S | OJH2 | H7J2 | 10 |  |  |
|  | OH7S | OJH3 | H7J3 | 60 |  |  |
|  | OH7S | OJH4 | H7J4 | 20 |  |  |
|  |  |  |  |  | VH | 100% |

TABLE 5

Characteristics of the individual IgM memory B cell libraries.

| | IgM memory libraries | | | | | |
|---|---|---|---|---|---|---|
| | | cells | | Libraries | | |
| Donor | Total PBL ($\times 10^6$) | % memory B cells | Size ($\times 10^6$) | % Insert frequency | % ORF | % Unique |
| Individual 1 | | | 3 | 96 | 74 | 98 |
| Individual 2 | 72.5 | 1.7 | 5 | 98 | 79 | 98 |
| Individual 3 | 67.5 | 1.4 | 3 | 96 | 79 | 98 |
| Individual 4 | 132.5 | 2.3 | 6 | 98 | 69 | 99 |

TABLE 6

Data of the HA-specific single-chain Fvs.

| Name scFv | SEQ ID NO (nucl sequence) | SEQ ID NO (amino acid sequence)* | VH-locus | VL-locus |
|---|---|---|---|---|
| SC06-141 | 212 | 213 (Vh 1-115; Vl 132-245) | VH1 (1-18) | VKIV (B3) |
| SC06-255 | 115 | 116 (Vh 1-121; Vl 138-248) | VH1 (1-69) | VL1 (V1-16) |
| SC06-257 | 117 | 118 (Vh 1-121; Vl 138-248) | VH1 (1-69) | VL2 (V1-4) |
| SC06-260 | 119 | 120 (Vh 1-121; Vl 138-248) | VH1 (1-69) | VL1 (V1-17) |
| SC06-261 | 121 | 122 (Vh 1-121; Vl 138-249) | VH1 (1-69) | VL1 (V1-19) |
| SC06-262 | 123 | 124 (Vh 1-120; Vl 137-245) | VH1 (1-69) | VKI (A20) |
| SC06-268 | 125 | 126 (Vh 1-120; Vl 137-243) | VH1 (1-69) | VL3 (V2-1) |
| SC06-272 | 214 | 215 (Vh 1-120; Vl 137-247) | VH1 (1-69) | VL2 (V1-3) |

TABLE 6-continued

Data of the HA-specific single-chain Fvs.

| Name scFv | SEQ ID NO (nucl sequence) | SEQ ID NO (amino acid sequence)* | VH-locus | VL-locus |
|---|---|---|---|---|
| SC06-296 | 216 | 217 (Vh 1-121; Vl 138-246) | VH1 (1-2) | VKIII (A27) |
| SC06-301 | 218 | 219 (Vh 1-117; Vl 134-246) | VH1 (3-23) | VKII (A3) |
| SC06-307 | 127 | 128 (Vh 1-122; Vl 139-246) | VH3 (3-21) | VKIII (A27) |
| SC06-310 | 129 | 130 (Vh 1-121; Vl 138-246) | VH1 (1-69) | VL3 (V2-14) |
| SC06-314 | 131 | 132 (Vh 1-121; Vl 138-248) | VH1 (1-69) | VL1 (V1-17) |
| SC06-323 | 133 | 134 (Vh 1-120; Vl 137-245) | VH1 (1-69) | VKIII (A27) |
| SC06-325 | 135 | 136 (Vh 1-121; Vl 138-248) | VH1 (1-69) | VL2 (V1-4) |
| SC06-327 | 220 | 221 (Vh 1-121; Vl 138-246) | VH1 (1-69) | VL3 (V2-14) |
| SCO6-328 | 222 | 223 (Vh 1-128; Vl 145-252) | VH1 (1-69) | VKIII (A27) |
| SC06-329 | 224 | 225 (Vh 1-121; Vl 138-246) | VH1 (1-69) | VKIII (A27) |
| SC06-331 | 137 | 138 (Vh 1-120; Vl 137-245) | VH1 (1-69) | VL3 (V2-14) |
| SC06-332 | 226 | 227 (Vh 1-120; Vl 137-243) | VH1 (1-69) | VKI (A20) |
| SC06-334 | 228 | 229 (Vh 1-120; Vl 137-245) | VH1 (1-69) | VL3 (V2-14) |
| SC06-336 | 230 | 231 (Vh 1-120; Vl 137-245) | VH1 (1-69) | VKIII (A27) |
| SC06-339 | 232 | 233 (Vh 1-121; Vl 138-246) | VH1 (1-69) | VL3 (V2-14) |
| SC06-342 | 234 | 235 (Vh 1-126; Vl 143-256) | VH1 (1-69) | VKIV (B3) |
| SC06-343 | 236 | 237 (Vh 1-120; Vl 137-245) | VH1 (1-69) | VL3 (V2-14) |
| SC06-344 | 139 | 140 (Vh 1-123; Vl 140-250) | VH1 (1-69) | VL1 (V1-13) |

*between brackets the amino acids making up the heavy chain variable region (VH) and the light chain variable region (VL) is shown

TABLE 7

Data of the CDR regions of the HA specific immunoglobulins. The SEQ ID NO is given between brackets.

| Name scFv | HCDR1 | HCDR2 | HCDR3 | LCDR1 | LCDR2 | LCDR3 |
|---|---|---|---|---|---|---|
| SC06-141 | GYYVY (238) | WISAYNGNTNY AQKFQG (239) | SRSLDV (240) | KSSQSVLYSSN NKNYLA (241) | WASTRES (242) | QQYYSTPLT (243) |
| SC06-255 | SYAIS (1) | GIIPIFGTTKY APKFQG (2) | HMGYQVRET MDV (3) | SGSTFNIGSNA VD (4) | SNNQRPS (5) | AAWDDILNV PV (6) |
| SC06-257 | SYAIS (1) | GIIPIFGTTKY APKFQG (2) | HMGYQVRET MDV (3) | TGTSSDVGGYN YVS (7) | EVSNRPS (8) | SSYTSSSTY V (9) |
| SC06-260 | SYAIS (1) | GIIPIFGTTKY APKFQG (2) | HMGYQVRET MDV (3) | SGSRSNVGDNS VY (10) | KNTQRPS (11) | VAWDDSVDG YV (12) |
| SC06-261 | SYAIS (1) | GIIPIFGTTKY APKFQG (2) | HMGYQVRET MDV (3) | SGSSSNIGNDY VS (13) | DNNKRPS (14) | ATWDRRPTA YVV (15) |
| SC06-262 | GSAIS (16) | GISPLFGTTNY AQKFQG (17) | GPKYYSEYM DV (18) | RASQGISSYLA (19) | DASTLRS (20) | QRYNSAPPI T (21) |
| SC06-268 | SYAIS (1) | GIMGMFGTTNY AQKFQG (22) | SSGYYPEYF QD (23) | SGHKLGDKYVS (24) | QDNRRPS (25) | QAWDSSTAV (26) |
| SC06-272 | SYAIT (244) | GIIGMFGSTNY AQNFQG (245) | STGYYPAYL HH (246) | TGTSSDVGGYN YVS (247) | DVSKRPS (248) | SSYTSSSTH V (249) |
| SC06-296 | SYYMH (250) | WINPNSGGTNY AQKFQG (251) | EGKWGPQAA FDI (252) | RASQSVSSSYL A (253) | DASSRAT (254) | QQYGSSLW (255) |
| SC06-301 | IYAMS (256) | AISSSGDSTYY ADSVKG (257) | AYGYTFDP (258) | RSSQSLLHSNG YNYLD (259) | LGSNRAS (260) | MQALQTPL (261) |
| SC06-307 | SYSMN (27) | SISSSSSYIYY VDSVKG (28) | GGGSYGAYE GFDY (29) | RASQRVSSYLA (30) | GASTRAA (31) | QQYGRTPLT (32) |
| SC06-310 | SYAIS (1) | GIIPIFGTTKY APKFQG (2) | HMGYQVRET MDV (3) | GGNNIGSKSVH (33) | DDSDRPS (34) | QVWDSSSDH AV (35) |
| SC06-314 | SYAIS (1) | GIIPIFGTTKY APKFQG (2) | HMGYQVRET MDV (3) | SGSSSNIGSNY VY (36) | RDGQRPS (37) | ATWDDNLSG PV (38) |
| SC06-323 | SYGIS (39) | DIIGMFGSTNY AQNFQG (40) | SSGYYPAYL PH (41) | RASQSVSSSYL A (42) | GASSRAT (43) | QQYGSSPRT (44) |

TABLE 7-continued

Data of the CDR regions of the HA specific immunoglobulins. The SEQ ID NO is given between brackets.

| Name scFv | HCDR1 | HCDR2 | HCDR3 | LCDR1 | LCDR2 | LCDR3 |
|---|---|---|---|---|---|---|
| SC06-325 | FYSMS (45) | GIIPMFGTTNY AQKFQG (46) | GDKGIYYYY MDV (47) | TGTSSDVGGYN YVS (7) | EVSNRPS (8) | SSYTSSSTL V (48) |
| SC06-327 | THAIS (262) | GIIAIFGTANY AQKFQG (263) | GSGYHISTP FDN (264) | GGNNIGSKGVH (265) | DDSDRPS (266) | QVWDSSSDH VV (267) |
| SC06-328 | GYAIS (268) | GIIPIFGTTNY AQKFQG (269) | VKDGYCTLT SCPVGWYFD L (270) | RASQSVSSSYL A (271) | GASSRAT (272) | QQYGSSLT (273) |
| SC06-329 | SNSIS (274) | GIFALFGTTDY AQKFQG (275) | GSGYTTRNY FDY (276) | RASQSVSSNYL G (277) | GASSRAS (278) | QQYGSSPLT (279) |
| SC06-331 | SYAIS (1) | GIIGMFGTANY AQKFQG (49) | GNYYYESSL DY (50) | GGNNIGSKSVH (33) | DDSDRPS (34) | QVWDSSSDH YV (51) |
| SC06-332 | NFAIN (280) | GIIAVFGTTKY AHKFQG (281) | GPHYYSSYM DV (282) | RASQGISTYLA (283) | AASTLQS (284) | QKYNSAPS (285) |
| SC06-334 | SNAVS (286) | GILGVFGSPSY AQKFQG (287) | GPTYYYSYM DV (288) | GGNNIGRNSVH (289) | DDSDRPS (290) | QVWHSSSDH YV (291) |
| SC06-336 | SYAIS (292) | GIFGMFGTANY AQKFQG (293) | SSGYYPQYF QD (294) | RASQSVSSSYL A (295) | GASSRAT (296) | QQYGSSSLT (297) |
| SC06-339 | SYAIS (298) | GIIAIFHTPKY AQKFQG (299) | GSTYDFSSG LDY (300) | GGNNIGSKSVH (301) | DDSDRPS (302) | QVWDSSSDH VV (303) |
| SC06-342 | SYAIS (304) | GVIPIFRTANY AQNFQG (305) | LNYHDSGTY YNAPRGWFD P (306) | KSSQSILNSSN NKNYLA (307) | WASTRES (308) | QQYYSSPPT (309) |
| SC06-343 | YYAMS (310) | GISPMFGTTTY AQKFQG (311) | SSNYYDSVY DY (312) | GGHNIGSNSVH (313) | DNSDRPS (314) | QVWGSSSDH YV (315) |
| SC06-344 | NYAMS (52) | GIIAIFGTPKY AQKFQG (53) | IPHYNFGSG SYFDY (54) | TGSSSNIGAGY DVH (55) | GNSNRPS (56) | GTWDSSLSA YV (57) |

TABLE 8

Data of the HA-specific IgGs.

| Name IgG | SEQ ID NO of nucl. sequence heavy chain | SEQ ID NO of amino acid sequence* heavy chain | SEQ ID NO of nucl. sequence light chain | SEQ ID NO of amino acid sequence* light chain |
|---|---|---|---|---|
| CR6141 | 316 | 317 (Vh 1-115) | 318 | 319 (Vl 1-114) |
| CR6255 | 58 | 59 (Vh 1-121) | 84 | 85 (Vl 1-111) |
| CR6257 | 60 | 61 (Vh 1-121) | 86 | 87 (Vl 1-111) |
| CR6260 | 62 | 63 (Vh 1-121) | 88 | 89 (Vl 1-111) |
| CR6261 | 64 | 65 (Vh 1-121) | 90 | 91 (Vl 1-112) |
| CR6262 | 66 | 67 (Vh 1-120) | 92 | 93 (Vl 1-109) |
| CR6268 | 68 | 69 (Vh 1-120) | 94 | 95 (Vl 1-107) |
| CR6272 | 320 | 321 (Vh 1-120) | 322 | 323 (Vl 1-111) |
| CR6296 | 324 | 325 (Vh 1-121) | 326 | 327 (Vl 1-109) |
| CR6301 | 328 | 329 (Vh 1-117) | 330 | 331 (Vl 1-113) |
| CR6307 | 70 | 71 (Vh 1-122) | 96 | 97 (Vl 1-108) |
| CR6310 | 72 | 73 (Vh 1-121) | 98 | 99 (Vl 1-109) |
| CR6314 | 74 | 75 (Vh 1-121) | 100 | 101 (Vl 1-111) |
| CR6323 | 76 | 77 (Vh 1-120) | 102 | 103 (Vl 1-109) |
| CR6325 | 78 | 79 (Vh 1-121) | 104 | 105 (Vl 1-111) |
| CR6327 | 332 | 333 (Vh 1-121) | 334 | 335 (Vl 1-109) |
| CR6328 | 336 | 337 (Vh 1-128) | 338 | 339 (Vl 1-108) |
| CR6329 | 340 | 341 (Vh 1-121) | 342 | 343 (Vl 1-109) |
| CR6331 | 80 | 81 (Vh 1-120) | 106 | 107 (Vl 1-109) |
| CR6332 | 344 | 345 (Vh 1-120) | 346 | 347 (Vl 1-107) |
| CR6334 | 348 | 349 (Vh 1-120) | 350 | 351 (Vl 1-109) |
| CR6336 | 352 | 353 (Vh 1-120) | 354 | 355 (Vl 1-109) |
| CR6339 | 356 | 357 (Vh 1-121) | 358 | 359 (Vl 1-109) |
| CR6342 | 360 | 361 (Vh 1-126) | 362 | 363 (Vl 1-114) |

TABLE 8-continued

Data of the HA-specific IgGs.

| Name IgG | SEQ ID NO of nucl. sequence heavy chain | SEQ ID NO of amino acid sequence* heavy chain | SEQ ID NO of nucl. sequence light chain | SEQ ID NO of amino acid sequence* light chain |
|---|---|---|---|---|
| CR6343 | 364 | 365 (Vh 1-120) | 366 | 367 (Vl 1-109) |
| CR6344 | 82 | 83 (Vh 1-123) | 108 | 109 (Vl 1-111) |

*between brackets the amino acids making up the heavy chain variable region (VH) and the light chain variable region (VL) is shown

TABLE 9

Binding of IgGs to HA (H5N1TV)-expressing PER.C6 cells.

| | HA (H5N1TV)-expressing PER.C6 cells | | | Control PER.C6 cells | | |
|---|---|---|---|---|---|---|
| Antibody | 10 µg/ml | 1 µg/ml | 0.1 µg/ml | 10 µg/ml | 1 µg/ml | 0.1 µg/ml |
| CR6255 | 414.18 | 257.13 | 60.43 | 3.16 | 2.64 | 2.48 |
| CR6257 | 365.17 | 283.87 | 62.08 | 2.59 | 2.44 | 2.53 |
| CR6260 | 323.42 | 168.49 | 31.06 | 5.42 | 3.34 | 2.57 |
| CR6261 | 330.77 | 278.81 | 85.82 | 29.43 | 13.22 | 3.89 |
| CR6262 | 84.29 | 20.91 | 8.06 | 2.71 | 2.53 | 2.48 |
| CR6268 | 421.70 | 218.70 | 43.71 | 3.82 | 2.74 | 2.50 |
| CR6307 | 484.78 | 266.55 | 82.42 | 4.87 | 3.02 | 2.48 |
| CR6314 | 399.54 | 166.98 | 44.51 | 5.99 | 3.49 | 2.64 |
| CR6323 | 445.08 | 116.52 | 33.38 | 5.05 | 2.92 | 2.71 |
| CR6325 | 478.29 | 239.28 | 64.36 | 4.00 | 3.11 | 2.57 |
| CR6344 | 768.25 | 328.16 | 106.65 | 80.90 | 26.33 | 10.17 |
| CR3014 | 13.10 | 10.00 | 6.21 | 3.11 | 2.69 | 2.55 |
| CR6310* | 597.04 | 290.93 | 86.91 | 14.92 | 6.05 | 4.42 |
| CR6331* | 421.14 | 165.43 | 41.04 | 7.87 | 4.59 | 4.55 |
| CR3014* | 9.15 | 7.95 | 10.51 | 4.74 | 4.12 | 4.57 |

*Indicates FACS analyses that were performed in a separate experiment

TABLE 10

Potency of the anti-HA antibodies in the neutralizing antibody titer assay.

| Antibody | Concentration (µg/ml) |
|---|---|
| CR6255 | 25 |
| CR6257 | 12.5 |
| CR6260 | 12.5 |
| CR6261 | 12.5 |
| CR6262 | 100 |
| CR6268 | 50 |
| CR6307 | 50 |
| CR6314 | 12.5 |
| CR6323 | 50 |
| CR6325 | 12.5 |
| CR6344 | 25 |
| CR6310 | 25 |
| CR6331 | 100 |
| CR4098 | —* |

*At 50 µg/ml no neutralization was observed

TABLE 11

Potency of the anti-HA antibodies in the neutralizing antibody titer assay.

| Antibody | Concentration (µg/ml) |
|---|---|
| CR6255 | 3.12 |
| CR6257 | 1.56 |
| CR6260 | 3.12 |
| CR6261 | 0.78 |
| CR6262 | 25 |
| CR6268 | 6.25 |
| CR6272 | — |
| CR6307 | 25 |
| CR6310 | 6.25 |
| CR6314 | 3.12 |
| CR6323 | 6.25 |
| CR6325 | 6.25 |
| CR6327 | 6.25 |
| CR6328 | 25 |
| CR6329 | 3.12 |
| CR6331 | 25 |
| CR6332 | 12.5 |
| CR6334 | 6.25 |
| CR6336 | 25 |
| CR6339 | — |
| CR6342 | 6.25 |
| CR6343 | 50 |
| CR6344 | 25 |

— means at 100 µg/ml no neutralization was observed

TABLE 12

Cross-reactivity of anti-H5N1 IgGs to HA molecules of different HA subtypes as measured by ELISA (OD 492 nm). ND: Not determined

| | H1 | H3 | H5 | H7 | H9 | BPL-inact. A/NC/20/99 (H1N1) | BPL-inact. NIBRG14 (H5N1) |
|---|---|---|---|---|---|---|---|
| CR6255 | 1.91 | 0.08 | 1.44 | 0.22 | 1.97 | 1.38 | 1.18 |
| CR6257 | 1.93 | 0.08 | 1.37 | 0.16 | 2.06 | 1.34 | 1.21 |
| CR6260 | 1.88 | 0.08 | 1.45 | 0.19 | 2.00 | 1.34 | 1.17 |
| CR6261 | 2.04 | 0.07 | 1.44 | 0.31 | 2.32 | 1.46 | 1.41 |
| CR6262 | 1.48 | 0.09 | 1.02 | 0.17 | 1.93 | 0.51 | 0.35 |
| CR6268 | 1.78 | 0.08 | 1.30 | 0.15 | 2.16 | 1.39 | 1.13 |
| CR6272 | 0.81 | 0.07 | 0.58 | 0.15 | 0.96 | 0.92 | 0.79 |
| CR6307 | 0.22 | 0.11 | 0.99 | 0.22 | 0.17 | 0.23 | 0.50 |
| CR6310 | 1.92 | 0.08 | 1.37 | 0.18 | 2.17 | 1.31 | 1.00 |
| CR6314 | 1.93 | 0.07 | 1.48 | 0.25 | 2.21 | 1.37 | 1.42 |
| CR6323 | 2.32 | 0.07 | 1.89 | 0.15 | 2.27 | 1.40 | 0.93 |
| CR6325 | 1.42 | 0.07 | 1.30 | 0.17 | 2.04 | 1.09 | 1.20 |
| CR6327 | 1.75 | 0.08 | 1.11 | 0.14 | 1.93 | 1.16 | 0.73 |
| CR6328 | 2.43 | 0.07 | 1.78 | 0.16 | 2.38 | 1.39 | 0.98 |
| CR6329 | 1.98 | 0.08 | 1.43 | 0.17 | 2.16 | 1.04 | 1.01 |
| CR6331 | 1.75 | 0.06 | 1.32 | 0.16 | 2.02 | 1.25 | 0.92 |
| CR6332 | 2.20 | 0.15 | 1.65 | 0.26 | 2.11 | 1.20 | 1.11 |
| CR6334 | 2.04 | 0.07 | 1.19 | 0.15 | 1.82 | 1.13 | 0.91 |
| CR6336 | 1.92 | 0.10 | 1.41 | 0.18 | 2.02 | 1.09 | 0.94 |
| CR6339 | 1.25 | 0.07 | 0.81 | 0.14 | 1.96 | 0.94 | 0.50 |
| CR6342 | 1.99 | 0.09 | 1.25 | 0.17 | 2.13 | 1.32 | 0.90 |
| CR6343 | 1.28 | 0.07 | 0.76 | 0.15 | 1.88 | 0.91 | 0.64 |
| CR6344 | 1.80 | 0.09 | 1.31 | 0.18 | 2.15 | 1.31 | 0.96 |
| CR5111 | 0.08 | 0.07 | 1.57 | 0.15 | 0.17 | 0.09 | 0.81 |
| CR3014 | 0.08 | 0.07 | 0.09 | 0.17 | 0.16 | 0.09 | 0.11 |
| No IgG | 0.13 | 0.08 | 0.09 | 0.15 | 0.16 | 0.09 | 0.14 |
| Sheep anti-H5 | ND | ND | ND | 0.90 | 2.07 | 2.62 | 2.93 |

TABLE 13

Epitope mapping of human anti-HA antibodies.

| | HA1 | HA2 | CR5111 | CR6342 C179 | CR6307 CR6323 | CR6261 CR6325 CR6329 |
|---|---|---|---|---|---|---|
| H5N1TV | TGLRN | GVTNKVNSIIDK | + | + | + | + |
| Mutant I | K---- | ------------ | + | − | + | + |
| Mutant II | ----- | -----E------ | + | − | + | − |
| Mutant III | --M-- | ------------ | + | + | + | + |
| Mutant IV | ----- | -------R---- | + | − | + | + |
| Mutant V | ----- | ----------N- | + | + | + | + |

TABLE 14

Clinical scores of mice pre-treated with antibody, followed by a lethal challenge with H5N1 influenza virus

| | | Number of mice showing clinical signs[a] Study day | | | | | | | | | | | | | | | | | | | | | | |
|---|---|---|---|---|---|---|---|---|---|---|---|---|---|---|---|---|---|---|---|---|---|---|---|---|
| Group ID | Ab-dose (mg/kg) | −1 | 0 | 1 | 2 | 3 | 4 | 5 | 6 | 7 | 8 | 9 | 10 | 11 | 12 | 13 | 14 | 15 | 16 | 17 | 18 | 19 | 20 | 21 |
| 1 | CR6261-15 | 0 | 0 | 0 | 0 | 0 | 0 | 0 | 0 | 0 | 0 | 0 | 0 | 0 | 0 | 0/9 | 0/9 | 0/9 | 0/9 | 0/9 | 0/9 | 0/9 | 0/9 | 0/9 |
| 2 | CR6261-5 | 0 | 0 | 0 | 0 | 0 | 0 | 0 | 0 | 0 | 0 | 0 | 2/9 | 2/9 | 1/8 | 0/7 | 0/7 | 0/7 | 0/7 | 0/7 | 0/7 | 0/7 | 0/7 | 0/7 |
| 3 | CR6261-2 | 0 | 0 | 0 | 0 | 0 | 0 | 0 | 2 | 5 | 5 | 4/9 | 3/8 | 0/7 | 0/7 | 0/7 | 0/7 | 0/7 | 0/7 | 0/7 | 0/7 | 0/7 | 0/7 | 0/7 |
| 4 | CR6261-0.7 | 0 | 0 | 0 | 0 | 0 | 0 | 10 | 10 | 8/8 | 7/7 | 7/7 | 6/6 | 4/4 | 4/4 | 4/4 | 4/4 | 4/4 | 4/4 | 4/4 | 1/4 | 1/4 | 1/4 | 1/4 |
| 5 | CR6323-15 | 0 | 0 | 0 | 0 | 0 | 0 | 1 | 1 | 1 | 1 | 0/9 | 0/9 | 0/9 | 0/9 | 0/9 | 0/9 | 0/9 | 0/9 | 0/9 | 0/9 | 0/9 | 0/9 | 0/9 |
| 6 | CR6325-15 | 0 | 0 | 0 | 0 | 0 | 0 | 0 | 0 | 0 | 0 | 0 | 0 | 0 | 0 | 0 | 0 | 0 | 0 | 0 | 0 | 0 | 0 | 0 |
| 7 | RaH5N3 | 0 | 0 | 0 | 0 | 0 | 0 | 5 | 10 | 10 | 6/6 | 1/1 | 1/1 | 0/0 | 0/0 | 0/0 | 0/0 | 0/0 | 0/0 | 0/0 | 0/0 | 0/0 | 0/0 | 0/0 |
| 8 | CR3014-15 | 0 | 0 | 0 | 0 | 10 | 10 | 10 | 10 | 9/9 | 5/5 | 1/1 | 1/1 | 0/0 | 0/0 | 0/0 | 0/0 | 0/0 | 0/0 | 0/0 | 0/0 | 0/0 | 0/0 | 0/0 |

[a]out of 10 unless indicated otherwise

TABLE 15

Respiratory distress of mice pre-treated with antibody, followed by a lethal challenge with H5N1 influenza virus

| | | Number of mice showing respiratory distress[a] Study day | | | | | | | | | | | | | | | | | | | | | | |
|---|---|---|---|---|---|---|---|---|---|---|---|---|---|---|---|---|---|---|---|---|---|---|---|---|
| Group ID | Ab-dose (mg/kg) | −1 | 0 | 1 | 2 | 3 | 4 | 5 | 6 | 7 | 8 | 9 | 10 | 11 | 12 | 13 | 14 | 15 | 16 | 17 | 18 | 19 | 20 | 21 |
| 1 | CR6261-15 | 0 | 0 | 0 | 0 | 0 | 0 | 0 | 0 | 0 | 0 | 0 | 0 | 0 | 0 | 0 | 0 | 0 | 0 | 0 | 0 | 0 | 0 | 0 |
| 2 | CR6261-5 | 0 | 0 | 0 | 0 | 0 | 0 | 0 | 0 | 0 | 0 | 0 | 0 | 2 | 1 | 0 | 0 | 0 | 0 | 0 | 0 | 0 | 0 | 0 |
| 3 | CR6261-2 | 0 | 0 | 0 | 0 | 0 | 0 | 0 | 0 | 0 | 0 | 1 | 1 | 0 | 0 | 0 | 0 | 0 | 0 | 0 | 0 | 0 | 0 | 0 |
| 4 | CR6261-0.7 | 0 | 0 | 0 | 0 | 0 | 0 | 0 | 0 | 8 | 7 | 7 | 6 | 4 | 4 | 4 | 4 | 4 | 0 | 0 | 0 | 0 | 0 | 0 |
| 5 | CR6323-15 | 0 | 0 | 0 | 0 | 0 | 0 | 0 | 0 | 0 | 0 | 0 | 0 | 0 | 0 | 0 | 0 | 0 | 0 | 0 | 0 | 0 | 0 | 0 |
| 6 | CR6325-15 | 0 | 0 | 0 | 0 | 0 | 0 | 0 | 0 | 0 | 0 | 0 | 0 | 0 | 0 | 0 | 0 | 0 | 0 | 0 | 0 | 0 | 0 | 0 |
| 7 | RaH5N3 | 0 | 0 | 0 | 0 | 0 | 0 | 0 | 0 | 10 | 6 | 1 | 1 | — | — | — | — | — | — | — | — | — | — | — |
| 8 | CR3014-15 | 0 | 0 | 0 | 0 | 0 | 0 | 0 | 10 | 9 | 5 | 1 | 1 | — | — | — | — | — | — | — | — | — | — | — |

TABLE 16

Clinical scores of mice infected with H5N1 virus and treated with antibody at different time points post-infection

| | | Number of mice showing clinical signs[a] Study day | | | | | | | | | | | | | | | | | | | | | | |
|---|---|---|---|---|---|---|---|---|---|---|---|---|---|---|---|---|---|---|---|---|---|---|---|---|
| Group ID | Time interval p.i. | −1 | 0 | 1 | 2 | 3 | 4 | 5 | 6 | 7 | 8 | 9 | 10 | 11 | 12 | 13 | 14 | 15 | 16 | 17 | 18 | 19 | 20 | 21 |
| 1 | 4 h | 0 | 0 | 0 | 4 | 4 | 2 | 2 | 2 | 0 | 0 | 0 | 0/9 | 0/9 | 0/9 | 0/9 | 0/9 | 0/9 | 0/9 | 0/9 | 0/9 | 0/9 | 0/9 | 0/9 |
| 2 | 1 d | 0 | 0 | 0 | 10 | 10 | 10 | 10 | 10 | 0 | 0 | 0 | 0 | 0 | 0 | 0 | 0 | 0 | 0 | 0 | 0 | 0 | 0 | 0 |
| 3 | 2 d | 0 | 0 | 0 | 3 | 10 | 10 | 10 | 10 | 8 | 9 | 9 | 8 | 5 | 4 | 2 | 0 | 0 | 0 | 0 | 0 | 0 | 0 | 0 |
| 4 | 3 d | 0 | 0 | 0 | 5 | 5 | 10 | 10 | 10 | 10 | 10 | 10 | 10 | 10 | 3 | 3 | 2 | 0 | 0 | 0 | 0 | 0 | 0 | 0 |
| 5 | CR2006 | 0 | 0 | 0 | 3 | 7 | 10 | 10 | 10 | 6/6 | 1/1 | 0 | 0 | 0 | 0 | 0 | 0 | 0 | 0 | 0 | 0 | 0 | 0 | 0 |

[a]with 14 mice in groups 2 and 5 until day 6 p.i.

TABLE 17

Respiratory distress of mice infected with H5N1 virus and treated with antibody at different time points post-infection

| Group ID | Time interval p.i. | Number of mice showing respiratory distress[a] Study day −1 | 0 | 1 | 2 | 3 | 4 | 5 | 6 | 7 | 8 | 9 | 10 | 11 | 12 | 13 | 14 | 15 | 16 | 17 | 18 | 19 | 20 | 21 |
|---|---|---|---|---|---|---|---|---|---|---|---|---|---|---|---|---|---|---|---|---|---|---|---|---|
| 1 | 4 h | 0 | 0 | 0 | 0 | 0 | 0 | 0 | 0 | 0 | 0 | 0 | 0 | 0 | 0 | 0 | 0 | 0 | 0 | 0 | 0 | 0 | 0 | 0 |
| 2 | 1 d | 0 | 0 | 0 | 0 | 0 | 0 | 2 | 2 | 0 | 0 | 0 | 0 | 0 | 0 | 0 | 0 | 0 | 0 | 0 | 0 | 0 | 0 | 0 |
| 3 | 2 d | 0 | 0 | 0 | 0 | 0 | 0 | 10 | 10 | 2 | 0 | 0 | 0 | 0 | 0 | 0 | 0 | 0 | 0 | 0 | 0 | 0 | 0 | 0 |
| 4 | 3 d | 0 | 0 | 0 | 0 | 0 | 0 | 10 | 10 | 5 | 9 | 7 | 7 | 4 | 1 | 0 | 0 | 0 | 0 | 0 | 0 | 0 | 0 | 0 |
| 5 | CR2006 | 0 | 0 | 0 | 0 | 0 | 0 | 10 | 10 | 6 | 1 | 0 | 0 | 0 | 0 | 0 | 0 | 0 | 0 | 0 | 0 | 0 | 0 | 0 |

[a]score 3

TABLE 18

Mortality of mice infected with H5N1 virus and treated with antibody at different time points post-infection

| Group ID | Time interval p.i. | Number of living mice on each study day Study day −1 | 0 | 1 | 2 | 3 | 4 | 5 | 6 | 7 | 8 | 9 | 10 | 11 | 12 | 13 | 14 | 15 | 16 | 17 | 18 | 19 | 20 | 21 |
|---|---|---|---|---|---|---|---|---|---|---|---|---|---|---|---|---|---|---|---|---|---|---|---|---|
| 1 | 4 h | 10 | 10 | 10 | 10 | 10 | 10 | 10 | 10 | 10 | 10 | 10 | 9 | 9 | 9 | 9 | 9 | 9 | 9 | 9 | 9 | 9 | 9 | 9 |
| 2 | 1 d | 10 | 10 | 10 | 10 | 10 | 10 | 10 | 10 | 10 | 10 | 10 | 10 | 10 | 10 | 10 | 10 | 10 | 10 | 10 | 10 | 10 | 10 | 10 |
| 3 | 2 d | 10 | 10 | 10 | 10 | 10 | 10 | 10 | 10 | 10 | 10 | 10 | 10 | 10 | 10 | 10 | 10 | 10 | 10 | 10 | 10 | 10 | 10 | 10 |
| 4 | 3 d | 10 | 10 | 10 | 10 | 10 | 10 | 10 | 10 | 10 | 10 | 10 | 10 | 10 | 10 | 10 | 10 | 10 | 10 | 10 | 10 | 10 | 10 | 10 |
| 5 | CR2006 | 10 | 10 | 10 | 10 | 10 | 10 | 10 | 10 | 6 | 1 | 0 | 0 | 0 | 0 | 0 | 0 | 0 | 0 | 0 | 0 | 0 | 0 | 0 |

TABLE 19

Mortality of mice infected with H1N1 virus and treated with antibody at different time points prior- and post-infection

| Time interval p.i. | Number of living mice on each study day Study day −1 | 0 | 1 | 2 | 3 | 4 | 5 | 6 | 7 | 8 | 9 | 10 | 11 | 12 | 13 | 14 | 15 | 16 | 17 | 18 | 19 | 20 | 21 |
|---|---|---|---|---|---|---|---|---|---|---|---|---|---|---|---|---|---|---|---|---|---|---|---|
| −1 d | 10 | 10 | 10 | 10 | 10 | 10 | 10 | 10 | 10 | 10 | 10 | 10 | 10 | 10 | 10 | 10 | 10 | 10 | 10 | 10 | 10 | 10 | 10 |
| 1 d | 10 | 10 | 9 | 9 | 9 | 9 | 9 | 9 | 9 | 9 | 9 | 9 | 9 | 9 | 9 | 9 | 9 | 9 | 9 | 9 | 9 | 9 | 9 |
| 2 d | 10 | 10 | 9 | 9 | 9 | 9 | 9 | 9 | 9 | 8 | 8 | 8 | 8 | 8 | 8 | 8 | 8 | 8 | 8 | 8 | 8 | 8 | 8 |
| 3 d | 10 | 10 | 10 | 10 | 10 | 10 | 10 | 9 | 9 | 8 | 8 | 8 | 8 | 8 | 8 | 8 | 8 | 8 | 8 | 8 | 8 | 8 | 8 |
| control | 10 | 10 | 10 | 10 | 10 | 10 | 10 | 10 | 5 | 2 | 0 | 0 | 0 | 0 | 0 | 0 | 0 | 0 | 0 | 0 | 0 | 0 | 0 |

TABLE 20

Clinical scores of mice infected with H1N1 virus and treated with antibody at different time points prior- and post-infection

| Group ID | Time interval p.i. | Number of mice showing clinical signs[a] Study day −1 | 0 | 1 | 2 | 3 | 4 | 5 | 6 | 7 | 8 | 9 | 10 | 11 | 12 | 13 | 14 | 15 | 16 | 17 | 18 | 19 | 20 | 21 |
|---|---|---|---|---|---|---|---|---|---|---|---|---|---|---|---|---|---|---|---|---|---|---|---|---|
| 6 | d −1 | 0 | 0 | 0 | 0 | 0 | 0 | 0 | 0 | 0 | 0 | 0 | 0 | 0 | 0 | 0 | 0 | 0 | 0 | 0 | 0 | 0 | 0 | 0 |
| 10 | d1 | 0 | 0 | 0 | 9 | 9 | 9 | 9 | 9 | 0 | 0 | 0 | 0 | 0 | 0 | 0 | 0 | 0 | 0 | 0 | 0 | 0 | 0 | 0 |
| 9 | d2 | 0 | 0 | 0 | 9 | 9 | 9 | 9 | 9 | 9 | 8/8 | 8/8 | 0/8 | 0/8 | 0/8 | 0/8 | 0/8 | 0/8 | 0/8 | 0/8 | 0/8 | 0/8 | 0/8 | 0/8 |
| 8 | d3 | 0 | 0 | 0 | 10 | 10 | 10 | 10 | 9/9 | 9/9 | 8/8 | 8/8 | 8/8 | 8/8 | 8/8 | 4/8 | 3/8 | 0/8 | 0/8 | 0/8 | 0/8 | 0/8 | 0/8 | 0/8 |
| 7 | control | 0 | 0 | 0 | 10 | 10 | 10 | 10 | 10 | 5/5 | 2/2 | | | | | | | | | | | | | |

[a]with 9 mice in the 1 d and 2 d p.i. treatment groups

TABLE 21

Respiratory distress of mice infected with H1N1 virus and treated with antibody at different time points prior- and post-infection

| | Number of mice showing respiratory distress[a] Study day | | | | | | | | | | | | | | | | | | | | | | |
|---|---|---|---|---|---|---|---|---|---|---|---|---|---|---|---|---|---|---|---|---|---|---|---|
| Time interval p.i. | −1 | 0 | 1 | 2 | 3 | 4 | 5 | 6 | 7 | 8 | 9 | 10 | 11 | 12 | 13 | 14 | 15 | 16 | 17 | 18 | 19 | 20 | 21 |
| −1 | 0 | 0 | 0 | 0 | 0 | 0 | 0 | 0 | 0 | 0 | 0 | 0 | 0 | 0 | 0 | 0 | 0 | 0 | 0 | 0 | 0 | 0 | 0 |
| 1 d | 0 | 0 | 0 | 4 | 7 | 10 | 2 | 0 | 0 | 0 | 0 | 0 | 0 | 0 | 0 | 0 | 0 | 0 | 0 | 0 | 0 | 0 | 0 |
| 2 d | 0 | 0 | 0 | 7 | 8 | 10 | 9 | 3 | 4 | 2 | 0 | 0 | 0 | 0 | 0 | 0 | 0 | 0 | 0 | 0 | 0 | 0 | 0 |
| 3 d | 0 | 0 | 0 | 4 | 10 | 9 | 10 | 9 | 9 | 8 | 8 | 8 | 8 | 6 | 0 | 0 | 0 | 0 | 0 | 0 | 0 | 0 | 0 |
| ctrl | 0 | 0 | 0 | 1 | 9 | 7 | 10 | 10 | 5 | 2 | | | | | | | | | | | | | |

[a]a score of 2 or 3

TABLE 22

Sequence of HA2 epitope in different influenza subtypes.

| | HA2 | SEQ ID NO: |
|---|---|---|
| H5N1: | | |
| A/Vietnam/1203/2004 | GVTNKVNSIIDK | 368 |
| H5N1: | | |
| A/Hong Kong/156/97 | GVTNKVNSIINK | 369 |
| H5N2: | | |
| A/mald/PA/84 | GVTNKVNSIIDK | 368 |
| H1N1: | | |
| A/PR/8/34<br>A/South Carolina/1/1918<br>A/WSN/33<br>A/New Caledonia/20/99<br>A/Bangkok/10/83<br>A/Yamagata/120/86 | GITNKVNSVIEK | 372 |
| H2N2: | | |
| A/Okuda/57<br>A/Kumamoto/1/65<br>A/Korea/426/68<br>A/Izumi/5/65 | GITNKVNSVIEK | 372 |
| H2N2: | | |
| A/Izumi/5/65 (R) | GITNKENSVIEK | 373 |
| H6N2: | | |
| A/Mallard/Netherlands/16/99 | GITNKVNSIIDK | 374 |
| H9N2: | | |
| A/Hong Kong/1073/99 | KITSKVNNIVDK | 375 |
| H3N2: | | |
| A/Aichi/2/68 | QINGKLNRVIEK | 376 |
| H3N2: | | |
| A/Fukuoka/C29/85 | QINGKLNRLIEK | 377 |

The underlined amino acid represents the valine (V) –> glutamic acid (E) substitution in the H2N2 escape mutant (mutant II; Table 13)

REFERENCES

Boel E et al. (2000), Functional human monoclonal antibodies of all isotypes constructed from phage display library-derived single-chain Fv antibody fragments. J. Immunol. Methods 239:153-166

Burton D R and Barbas C F (1994), Human antibodies from combinatorial libraries. Adv. Immunol. 57:191-280

Chou T C and P Talalay (1984) Quantitative analysis of dose-effect relationships: the combined effects of multiple drugs or enzyme inhibitors. Adv Enzyme Regul 22:27-55

De Kruif J et al. (1995a), Rapid selection of cell subpopulation-specific human monoclonal antibodies from a synthetic phage antibody library. Proc Natl Acad Sci USA 92:3938

De Kruif J et al. (1995b) Selection and application of human single-chain Fv antibody fragments from a semi-synthetic phage antibody display library with designed CDR3 regions. J. Mol. Biol. 248:97-105.

Huls G et al. (1999) Antitumor immune effector mechanisms recruited by phage display-derived fully human IgG1 and IgA1 monoclonal antibodies. Cancer Res 59:5778-5784

Okuno Y et al (1993) A common neutralizing epitope conserved between the hemagglutinins of Influenza A virus H1 and H2 strains. J. Virol. 67:2552-2558.

Slootstra J W et al. (1996) Structural aspects of antibody-antigen interaction revealed through small random peptide libraries. Mol. Divers. 1:87-96.

Smirnov Y A et at (1999) An epitope shared by the hemagglutinins of H1, H2, H5 and H6 subtypes of influenza A virus. Acta Virol. 43:237-244.

The World Health Organization Global Influenza Program Surveillance Network (2005), Evolution of H5N1 Avian Influenza Viruses in Asia. Emerg Infect Dis 11:1515-1521

SEQUENCE LISTING (377 sequences)

SEQ ID NO: 1 - protein, 5 aa, Homo sapiens
SYAIS

SEQ ID NO: 2 - protein, 17 aa, Homo sapiens
GIIPIFGTTKYAPKFQG

SEQ ID NO: 3 - protein, 12 aa, Homo sapiens
HMGYQVRETMDV

SEQ ID NO: 4 - protein, 13 aa, Homo sapiens
SGSTFNIGSNAVD

SEQ ID NO: 5 - protein, 7 aa, Homo sapiens
SNNQRPS

SEQ ID NO: 6 - protein, 11 aa, Homo sapiens
AAWDDILNVPV

SEQ ID NO: 7 - protein, 14 aa, Homo sapiens
TGTSSDVGGYNYVS

SEQ ID NO: 8 - protein, 7 aa, Homo sapiens
EVSNRPS

SEQ ID NO: 9 - protein, 10 aa, Homo sapiens
SSYTSSSTYV

SEQ ID NO: 10 - protein, 13 aa, Homo sapiens
SGSRSNVGDNSVY

SEQ ID NO: 11 - protein, 7 aa, Homo sapiens
KNTQRPS

SEQ ID NO: 12 - protein, 11 aa, Homo sapiens
VAWDDSVDGYV

SEQ ID NO: 13 - protein, 13 aa, Homo sapiens
SGSSSNIGNDYVS

SEQ ID NO: 14 - protein, 7 aa, Homo sapiens
DNNKRPS

SEQ ID NO: 15 - protein, 12 aa, Homo sapiens
ATWDRRPTAYVV

SEQ ID NO: 16 - protein, 5 aa, Homo sapiens
GSAIS

SEQ ID NO: 17 - protein, 17 aa, Homo sapiens
GISPLFGTTNYAQKFQG

SEQ ID NO: 18 - protein, 11 aa, Homo sapiens
GPKYYSEYMDV

SEQ ID NO: 19 - protein, 11 aa, Homo sapiens
RASQGISSYLA

SEQ ID NO: 20 - protein, 7 aa, Homo sapiens
DASTLRS

SEQ ID NO: 21 - protein, 10 aa, Homo sapiens
QRYNSAPPIT

SEQ ID NO: 22 - protein, 17 aa, Homo sapiens
GIMGMFGTTNYAQKFQG

SEQ ID NO: 23 - protein, 11 aa, Homo sapiens
SSGYYPEYFQD

SEQ ID NO: 24 - protein, 11 aa, Homo sapiens
SGHKLGDKYVS

SEQ ID NO: 25 - protein, 7 aa, Homo sapiens
QDNRRPS

SEQ ID NO: 26 - protein, 9 aa, Homo sapiens
QAWDSSTAV

SEQ ID NO: 27 - protein, 5 aa, Homo sapiens
SYSMN

SEQ ID NO: 28 - protein, 17 aa, Homo sapiens
SISSSSSYIYYVDSVKG

SEQ ID NO: 29 - protein, 13 aa, Homo sapiens
GGGSYGAYEGFDY

SEQ ID NO: 30 - protein, 11 aa, Homo sapiens
RASQRVSSYLA

SEQ ID NO: 31 - protein, 7 aa, Homo sapiens
GASTRAA

SEQ ID NO: 32 - protein, 9 aa, Homo sapiens
QQYGRTPLT

SEQ ID NO: 33 - protein, 11 aa, Homo sapiens
GGNNIGSKSVH

SEQ ID NO: 34 - protein, 7 aa, Homo sapiens
DDSDRPS

SEQ ID NO: 35 - protein, 11 aa, Homo sapiens
QVWDSSSDHAV

SEQ ID NO: 36 - protein, 13 aa, Homo sapiens
SGSSSNIGSNYVY

SEQ ID NO: 37 - protein, 7 aa, Homo sapiens
RDGQRPS

SEQ ID NO: 38 - protein, 11 aa, Homo sapiens
ATWDDNLSGPV

SEQ ID NO: 39 - protein, 5 aa, Homo sapiens
SYGIS

SEQ ID NO: 40 - protein, 17 aa, Homo sapiens
DIIGMFGSTNYAQNFQG

SEQ ID NO: 41 - protein, 11 aa, Homo sapiens
SSGYYPAYLPH

SEQ ID NO: 42 - protein, 12 aa, Homo sapiens
RASQSVSSSYLA

SEQ ID NO: 43 - protein, 7 aa, Homo sapiens
GASSRAT

SEQ ID NO: 44 - protein, 9 aa, Homo sapiens
QQYGSSPRT

SEQ ID NO: 45 - protein, 5 aa, Homo sapiens
FYSMS

SEQ ID NO: 46 - protein, 17 aa, Homo sapiens
GIIPMFGTTNYAQKFQG

SEQ ID NO: 47 - protein, 12 aa, Homo sapiens
GDKGIYYYYMDV

SEQ ID NO: 48 - protein, 10 aa, Homo sapiens
SSYTSSSTLV

SEQ ID NO: 49 - protein, 17 aa, Homo sapiens
GIIGMFGTANYAQKFQG

SEQ ID NO: 50 - protein, 11 aa, Homo sapiens
GNYYYESSLDY

SEQ ID NO: 51 - protein, 11 aa, Homo sapiens
QVWDSSSDHYV

SEQ ID NO: 52 - protein, 5 aa, Homo sapiens
NYAMS

SEQ ID NO: 53 - protein, 17 aa, Homo sapiens
GIIAIFGTPKYAQKFQG

SEQ ID NO: 54 - protein, 14 aa, Homo sapiens
IPHYNFGSGSYFDY

SEQ ID NO: 55 - protein, 14 aa, Homo sapiens
TGSSSNIGAGYDVH

SEQ ID NO: 56 - protein, 7 aa, Homo sapiens
GNSNRPS

SEQ ID NO: 57 - protein, 11 aa, Homo sapiens
GTWDSSLSAYV

SEQ ID NO: 58 - DNA, 1353 bp, Homo sapiens
  CDS (1)..(1353)
gaggtgcagctggtggagtctggggctgaggtgaagaagcctgggtcctcggtgaaagtctcttgcaaggcttctggaggccccttccgcagctatgctatcagctgggtgcgacaggcccctggacaagggcctgagtggatgggagggatcatccctatttttggtacaacaaaatacgcaccgaagttccagggcagagtcacgattaccgcggacgatttcgcgggcacagtttacatggagctgagcagcctgcgatctgaggacacggccatgtactactgtgcgaaacatatggggtaccaggtgcgcgaaactatggacgtctggggcaaagggaccacggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 59 - protein, 451 aa, Homo sapiens
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 60 - DNA, 1353 bp, Homo sapiens
  CDS (1)..(1353)
caggtccagctggtgcagtctggggctgaggtgaagaagcctgggtcctcggtgaaagtctcttgcaaggcttctggaggccccttccgcagctatgctatcagctgggtgcgacaggcccctggacaagggcctgagtggatgggagggatcatccctatttttggtacaacaaaatacgcaccgaagttccagggcagagtcacgattaccgcggacgatttcgcgggcacagtttacatggagctgagcagcctgcgatctgaggacacggccatgtactactgtgcgaaacatatggggtaccaggtgcgcgaaactatggacgtctggggcaaagggaccacggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 61 - protein, 451 aa, Homo sapiens
QVQLVQSGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 62 - DNA, 1353 bp, Homo sapiens; identical to SEQ ID NO: 58
  CDS (1)..(1353)

SEQ ID NO: 63 - protein, 451 aa, Homo sapiens; identical to SEQ ID NO: 59

SEQ ID NO: 64 - DNA, 1353 bp, Homo sapiens; identical to SEQ ID NO: 58
  CDS (1)..(1353)

SEQ ID NO: 65 - protein, 451 aa, Homo sapiens; identical to SEQ ID NO: 59

SEQ ID NO: 66 - DNA, 1350 bp, Homo sapiens
  CDS (1)..(1350)
caggtacagctgcagcagtcaggggctgaggtgaagaagcctgggtcctcggtgaaggtctcctgcaaggtttccggagtcattttcagcggcagtgcgatcagctgggtgcgacaggcccctggacaaggccttgagtggatgggagggatcagccctctctttggcacaacaaattacgcacaaaagttccagggcagagtcacgattaccgcggaccaatccacgaacacaacctacatggaggtgaacagcctgagatatgaggacacggccgtgtatttctgtgcgcgaggtccaaaatattacagtgagtacatggacgtctggggcaaagggaccacggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 67 - protein, 450 aa, Homo sapiens
QVQLQQSGAEVKKPGSSVKVSCKVSGVIFSGSAISWVRQAPGQGLEWMGGISPLFGTTNYAQKFQGRVTITADQSTNTTYMEVNSLRYEDTAVYFCARGPKYYSEYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 68 - DNA, 1350 bp, Homo sapiens
  CDS (1)..(1350)
caggtccagctggtacagtctggggctgaggtgaagaagcctgggtcctcggtgaaggtctcctgcaaggcttctggaggcaccttcagtagttatgctatcagctgggtgcgacaggcccctggacaagggcttgagtggatgggaggaatcatgggtatgtttggcacaactaactacgcacagaagttccagggcagagtcacgattaccgcggacgaattcacgagcgcagcctacatggagctgaggagcctgagatctgaggacacggccgtctactactgtgcgaggtctagtggttattaccccgaatacttccaggactggggccagggcaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 69 - protein, 450 aa, Homo sapiens
QVQLVQSGAEVKKPGSSVKVSCKASGGTFSSYAISWVRQAPGQGLEWMGGIMGMFGTTNYAQKFQGRVTITADEFTSAAYMELRSLRSEDTAVYYCARSSGYYPEYFQDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 70 - DNA, 1356 bp, Homo sapiens
  CDS (1)..(1356)
caggtccagctggtgcagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgtagactcagtgaagggccgattcaccatctccagagacaacgccaagaactcactgtatctgcaaatgaacagcctgagagccgaggacacggctgtgtattactgtgcgagaggtggtgggagctacggggcctacgaaggctttgactactggggccagggcaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 71 - protein, 452 aa, Homo sapiens
QVQLVQSGGGLVKPGGSLRLSCAASGFTFSSYSMNWVRQAPGKGLEWVSSISSSSSYIYYVDSVKGRFTISRDNAKNSLYLQMNSLRAEDTAVYYCARGGGSYGAYEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 72 - DNA, 1353 bp, Homo sapiens; identical to SEQ ID NO: 58
  CDS (1)..(1353)

SEQ ID NO: 73 - protein, 451 aa, Homo sapiens; identical to SEQ ID NO: 59

SEQ ID NO: 74 - DNA, 1353 bp, Homo sapiens; identical to SEQ ID NO: 58
  CDS (1)..(1353)

SEQ ID NO: 75 - protein, 451 aa, Homo sapiens; identical to SEQ ID NO: 59

SEQ ID NO: 76 - DNA, 1350 bp, Homo sapiens
  CDS (1)..(1350)
gaggtgcagctggtggagtctggggctgaggtgaagaagccagggtcctcggtgaaggtctcctgtaaggcctctggaggcaccttctccagctatggtatcagctgggtgcgacaggcccctggacaagggcttgagtggatgggagacatcatcggtatgtttggttcaacaaactacgcacagaacttccagggcagactcacgattaccgcggacgaatccacgagcacagcctacatggagctgagcagcctgagatctgaggacacggccgtgtattactgtgcgagaagtagtggttattaccctgcatacctcccccactggggccagggcaccttggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 77 - protein, 450 aa, Homo sapiens
EVQLVESGAEVKKPGSSVKVSCKASGGTFSSYGISWVRQAPGQGLEWMGDIIGMFGSTNYAQNFQGRLTITADESTSTAYMELSSLRSEDTAVYYCARSSGYYPAYLPHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - DNA, 1353 bp, Homo sapiens
  CDS (1)..(1353)
gaggtgcagctggtggagtctggggctgaggtgaagaagccggggtcctcggtgaaggtctcctgcaaggcttctggaggcaccttcagcttctattctatgagctgggtgcgacaggcccctggacaaggacttgagtggatgggagggatcatccctatgtttggtacaacaaactacgcacagaagttccagggcagagtcacgattaccgcggtcgaatccacgagcacagcctacatggaggtgagcagcctgagatctgaggacacggccgtttattactgtgcgagaggtgataagggtatctactactactacatggacgtctggggcaaagggaccacggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 79 - protein, 451 aa, Homo sapiens
EVQLVESGAEVKKPGSSVKVSCKASGGTFSFYSMSWVRQAPGQGLEWMGGIIPMFGTTNYAQKFQGRVTITAVESTSTAYMEVSSLRSEDTAVYYCARGDKGIYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 80 - DNA, 1350 bp, Homo sapiens
  CDS (1)..(1350)
gaggtgcagctggtggagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatcggtatgttcggtacagcaaactacgcacagaagttccagggcagagtcacgattaccgcggacgaatttacgagcacagcctacatggagctgagcagcctgagatctgaggacacggccgtgtattactgtgcgagaggaaattattactatgagagtagtctcgactactggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 81 - protein, 450 aa, Homo sapiens
EVQLVESGAEVKKPGSSVKVSCKASGGTFSSYAISWVRQAPGQGLEWMGGIIGMFGTANYAQKFQGRVTITADEFTSTAYMELSSLRSEDTAVYYCARGNYYYESSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - DNA, 1359 bp, Homo sapiens
  CDS (1)..(1359)
caggtgcagctggtgcagtctggggctgaggtgaagaagcctgggtcctcggtgagagtctcctgcaaggcttctggaagcatcttcagaaactatgctatgagctgggtgcgacaggcccctggacaagggcttgagtggatgggagggatcatcgctatttttgggacaccaaagtacgcacagaagttccagggcagagtcacgattaccgcggacgaatcgacgagcactgtctacatggaactgagcggactgagatctgaggacacggccatgtattactgtgcgaggattccccactataattttggttcggggagttatttcgactactggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 83 - protein, 453 aa, Homo sapiens
QVQLVQSGAEVKKPGSSVRVSCKASGSIFRNYAMSWVRQAPGQGLEWMGGIIAIFGTPKYAQKFQGRVTITADESTSTVYMELSGLRSEDTAMYYCARIPHYNFGSGSYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 84 - DNA, 660 bp, Homo sapiens
  CDS (1)..(660)
tcctatgtgctgactcagccaccctcagcgtctgggacccccgggcagagggtcaccatctcttgttctggaagcacgttcaacatcggaagtaatgctgtagactggtaccggcagctcccaggaacggcccccaaactcctcatctatagtaataatcagcggccctcaggggtccctgaccgattctctggctccaggtctggcacctcagcctccctggccatcagtgggctccagtctgaggatgaggctgattattactgtgcagcatgggatgacatcctgaatgttccggtattcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 85 - protein, 220 aa, Homo sapiens
SYVLTQPPSASGTPGQRVTISCSGSTFNIGSNAVDWYRQLPGTAPKLLIYSNNQRPSGVPDRFSGSRSGTSASLAISGLQSEDEADYYCAAWDDILNVPVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 86 - DNA, 660 bp, Homo sapiens
  CDS (1)..(660)
cagtctgccctgactcagcctgccgccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcacttatgtcttcggaactgggaccaaggtcaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 87 - protein, 220 aa, Homo sapiens
QSALTQPAAVSGSPGQSITISCTGTSSDVGGYNYVSWYQQHPGKAPKLMIYEVSNRPSGVSNRFSGSKSGNTASLTISGLQAEDEADYYCSSYTSSSTYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 88 - DNA, 660 bp, Homo sapiens
  CDS (1)..(660)
tcctatgtgctgactcagccaccctcagtctctgggacccccgggcagagggtcaccatctcttgctctggaagccgctccaacgtcggagataattctgtatattggtatcaacacgtcccagaaatggcccccaaactcctcgtctataagaatactcaacggccctcaggagtccctgcccggttttccggctccaagtctggcacttcagcctccctggccatcattggcctccagtccggcgatgaggctgattattattgtgtggcatgggatgacagcgtagatggctatgtcttcggatctgggaccaaggtcaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 89 - protein, 220 aa, Homo sapiens
SYVLTQPPSVSGTPGQRVTISCSGSRSNVGDNSVYWYQHVPEMAPKLLVYKNTQRPSGVPARFSGSKSGTSASLAIIGLQSGDEADYYCVAWDDSVDGYVFGSGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 90 - DNA, 663 bp, Homo sapiens
  CDS (1)..(663)
cagtctgtgttgacgcagccgccctcagtgtctgcggccccaggacagaaggtcaccatctcctgctctggaagcagctccaacattgggaatgattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccaactattactgcgcaacatgggatcgccgcccgactgcttatgttgtcttcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 91 - protein, 221 aa, Homo sapiens
QSVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 92 - DNA, 642 bp, Homo sapiens
  CDS (1)..(642)
gacatccagatgacccagtctccatcctccctgtctgcatctgtaggagacagagtcaccatcacttgccgggcgagtcagggcattagcagttatttagcctggtatcagcagaagccagggaaagttcctacactcctgatctatgatgcatccactttgcgatcaggggtcccatctcgcttcagtggcagtggatctgcgacagatttcactctcaccatcagcagcctgcagcctgaagatgttgcaacttattactgtcaaaggtataacagtgcccccccgatcaccttcggccaagggacacgactggagattaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 93 - protein, 214 aa, Homo sapiens
DIQMTQSPSSLSASVGDRVTITCRASQGISSYLAWYQQKPGKVPTLLIYDASTLRSGVPSRFSGSGSATDFTLTISSLQPEDVATYYCQRYNSAPPITFGQGTRLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 94 - DNA, 648 bp, Homo sapiens
  CDS (1)..(648)
cagtctgtgctgactcagccaccctcagagtccgtgtccccaggacagacagccagcgtcacctgctctggacataaattgggggataaatatgtttcgtggtatcagcagaagccaggccagtcccctgtattactcatctatcaagataacaggcggccctcagggatccctgagcgattcataggctccaactctgggaacacagccactctgaccatcagcgggacccaggctctggatgaggctgactattactgtcaggcgtgggacagcagcactgcggttttcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 95 - protein, 216 aa, Homo sapiens
QSVLTQPPSESVSPGQTASVTCSGHKLGDKYVSWYQQKPGQSPVLLIYQDNRRPSGIPERFIGSNSGNTATLTISGTQALDEADYYCQAWDSSTAVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 96 - DNA, 639 bp, Homo sapiens
  CDS (1)..(639)
gaaattgtgctgactcagtctccaggcaccctgtctttgtctccaggggaaagagccaccctctcctgcagggccagtcagcgtgttagcagctacttagcctggtaccaacagaaacctggccaggctcccaggctcctcatctatggtgcatccaccagggccgctggcatcccagacaggttcagtggcagtgggtctgggacagacttcactctcaccatcagcagactggagcctgaagattctgcagtgtattactgtcagcagtatggtaggacaccgctcactttcggcggagggaccaaggtggagatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 97 - protein, 213 aa, Homo sapiens
EIVLTQSPGTLSLSPGERATLSCRASQRVSSYLAWYQQKPGQAPRLLIYGASTRAAGIPDRFSGSGSGTDFTLTISRLEPEDSAVYYCQQYGRTPLTFGGGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 98 - DNA, 654 bp, Homo sapiens
  CDS (1)..(654)
tcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatgctgtgttcggaggaggcacccagctgaccgtcctcggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 99 - protein, 218 aa, Homo sapiens
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDHAVFGGGTQLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 100 - DNA, 660 bp, Homo sapiens
  CDS (1)..(660)
tcctatgtgctgactcagccaccctcagcgtctgggacccccgggcagagggtcaccatctcttgttctggaagcagctccaacatcggaagtaattatgtatactggtaccagcagctcccaggcacggcccccaaactcctcatctatagggatggtcagcggccctcaggggtccctgaccgattctctggctccaagtctggcacctcagcctccctggccatcagtggactccggtccgatgatgaggctgattattactgtgcaacatgggatgacaacctgagtggtccagtattcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 101 - protein, 220 aa, Homo sapiens
SYVLTQPPSASGTPGQRVTISCSGSSSNIGSNYVYWYQQLPGTAPKLLIYRDGQRPSGVPDRFSGSKSGTSASLAISGLRSDDEADYYCATWDDNLSGPVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 102 - DNA, 642 bp, Homo sapiens
  CDS (1)..(642)
gaaattgtgttgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacccagaactttcggcggagggaccaaggtggagatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 103 - protein, 214 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGGGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 104 - DNA, 660 bp, Homo sapiens
  CDS (1)..(660)
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactcttgtcttcggaactgggaccaaggtcaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 105 - protein, 220 aa, Homo sapiens
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 106 - DNA, 654 bp, Homo sapiens
  CDS (1)..(654)
cagtctgtcgtgacgcagccgccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcattatgtcttcggaactgggaccaaggtcaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 107 - protein, 218 aa, Homo sapiens
QSVVTQPPSVSVAPGQTARITCGGNNIGSKSVHWYQQKPGQAPVLVVYDDSDRPSGIPERFSGSNSGNTATLTISRVEAGDEADYYCQVWDSSSDHYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 108 - DNA, 660 bp, Homo sapiens
  CDS (1)..(660)
actgtgttgacacagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacgtcagccaccctgggcatcaccggactccagactggggacgaggccgattattactgcggaacatgggatagcagcctgagtgcttatgtcttcggaactgggaccaaggtcaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 109 - protein, 220 aa, Homo sapiens
TVLTQPPSVSGAPGQRVTISCTGSSSNIGAGYDVHWYQQLPGTAPKLLIYGNSNRPSGVPDRFSGSKSGTSATLGITGLQTGDEADYYCGTWDSSLSAYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 110 - protein, 565 aa, Influenza A virus
  MISC_FEATURE (1)..(565): HA protein of influenza virus H5N1 isolate A/Vietnam/1203/2004
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCR

SEQ ID NO: 111 - protein, 565 aa, Influenza A virus
  MISC_FEATURE: HA protein of influenza virus H5N1 isolate A/Vietnam/1194/2004 (H5N1TV)
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCR

SEQ ID NO: 112 - protein, 565 aa, Influenza A virus
  MISC_FEATURE: Consensus amino acid sequence representing HAs from strains isolated in Indonesia and China (H5N1IC)
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGKSSFFRNVVWLIKKNSSYPTIKRSYNNTNQEDLLVLWGIHHPNDAAEQTRLYQNPTTYISVGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCR

SEQ ID NO: 113 - protein, 567 aa, Influenza A virus
  MISC_FEATURE: Soluble part of HA from H5N1TV
  MISC_FEATURE (533)..(546): Spacer
  MISC_FEATURE (547)..(556): Myc-tag
  MISC_FEATURE (557)..(561): Spacer
  MISC_FEATURE (562)..(567): His-tag
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQIQHSGGRSSLEGPRFEQKLISEEDLNMHTGHHHHHH

SEQ ID NO: 114 - protein, 567 aa, Influenza A virus
  MISC_FEATURE: Soluble part of HA from H5N1IC
  MISC_FEATURE (533)..(546): Spacer
  MISC_FEATURE (547)..(556): Myc-tag
  MISC_FEATURE (557)..(561): Spacer
  MISC_FEATURE (562)..(567): His-tag
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGKSSFFRNVVWLIKKNSSYPTIKRSYNNTNQEDLLVLWGIHHPNDAAEQTRLYQNPTTYISVGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQIQHSGGRSSLEGPRFEQKLISEEDLNMHTGHHHHHH

SEQ ID NO: 115 - DNA, 744 bp, Artificial
  SC06-255
  CDS (1)..(744)
gaggtgcagctggtggagtctggggctgaggtgaagaagcctgggtcctcggtgaaagtctcttgcaaggcttctggaggccccttccgcagctatgctatcagctgggtgcgacaggcccctggacaagggcctgagtggatgggagggatcatccctatttttggtacaacaaaatacgcaccgaagttccagggcagagtcacgattaccgcggacgatttcgcgggcacagtttacatggagctgagcagcctgcgatctgaggacacggccatgtactactgtgcgaaacatatggggtaccaggtgcgcgaaactatggacgtctggggcaaagggaccacggtcaccgtctcgagcggtacgggcggttcaggcggaaccggcagcggcactggcgggtcgacgtcctatgtgctgactcagccaccctcagcgtctgggacccccgggcagagggtcaccatctcttgttctggaagcacgttcaacatcggaagtaatgctgtagactggtaccggcagctcccaggaacggcccccaaactcctcatctatagtaataatcagcggccctcaggggtccctgaccgattctctggctccaggtctggcacctcagcctccctggccatcagtgggctccagtctgaggatgaggctgattattactgtgcagcatgggatgacatcctgaatgttccggtattcggcggagggaccaagctgaccgtcctaggt

SEQ ID NO: 116 - protein, 248 aa, Artificial
  Synthetic Construct
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTSYVLTQPPSASGTPGQRVTISCSGSTFNIGSNAVDWYRQLPGTAPKLLIYSNNQRPSGVPDRFSGSRSGTSASLAISGLQSEDEADYYCAAWDDILNVPVFGGGTKLTVLG

SEQ ID NO: 117 - DNA, 744 bp, Artificial
  SC06-257
  CDS (1)..(744)
caggtccagctggtgcagtctggggctgaggtgaagaagcctgggtcctcggtgaaagtctcttgcaaggcttctggaggccccttccgcagctatgctatcagctgggtgcgacaggcccctggacaagggcctgagtggatgggagggatcatccctatttttggtacaacaaaatacgcaccgaagttccagggcagagtcacgattaccgcggacgatttcgcgggcacagtttacatggagctgagcagcctgcgatctgaggacacggccatgtactactgtgcgaaacatatggggtaccaggtgcgcgaaactatggacgtctggggcaaagggaccacggtcaccgtctcgagcggtacgggcggttcaggcggaaccggcagcggcactggcgggtcgacgcagtctgccctgactcagcctgccgccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcacttatgtcttcggaactgggaccaaggtcaccgtcctaggt

SEQ ID NO: 118 - protein, 248 aa, Artificial
  Synthetic Construct
QVQLVQSGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTQSALTQPAAVSGSPGQSITISCTGTSSDVGGYNYVSWYQQHPGKAPKLMIYEVSNRPSGVSNRFSGSKSGNTASLTISGLQAEDEADYYCSSYTSSSTYVFGTGTKVTVLG

SEQ ID NO: 119 - DNA, 744 bp, Artificial
  SC06-260
  CDS (1)..(744)
gaggtgcagctggtggagtctggggctgaggtgaagaagcctgggtcctcggtgaaagtctcttgcaaggcttctggaggccccttccgcagctatgctatcagctgggtgcgacaggcccctggacaagggcctgagtggatgggagggatcatccctatttttggtacaacaaaatacgcaccgaagttccagggcagagtcacgattaccgcggacgatttcgcgggcacagtttacatggagctgagcagcctgcgatctgaggacacggccatgtactactgtgcgaaacatatggggtaccaggtgcgcgaaactatggacgtctggggcaaagggaccacggtcaccgtctcgagcggtacgggcggttcaggcggaaccggcagcggcactggcgggtcgacgtcctatgtgctgactcagccaccctcagtctctgggacccccgggcagagggtcaccatctcttgctctggaagccgctccaacgtcggagataattctgtatattggtatcaacacgtcccagaaatggcccccaaactcctcgtctataagaatactcaacggccctcaggagtccctgcccggttttccggctccaagtctggcacttcagcctccctggccatcattggcctccagtccggcgatgaggctgattattattgtgtggcatgggatgacagcgtagatggctatgtcttcggatctgggaccaaggtcaccgtcctaggt

SEQ ID NO: 120 - protein, 248 aa, Artificial
  Synthetic Construct
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTSYVLTQPPSVSGTPGQRVTISCSGSRSNVGDNSVYWYQHVPEMAPKLLVYKNTQRPSGVPARFSGSKSGTSASLAIIGLQSGDEADYYCVAWDDSVDGYVFGSGTKVTVLG

SEQ ID NO: 121 - DNA, 747 bp, Artificial
  SC06-261
  CDS (1)..(747)
gaggtgcagctggtggagtctggggctgaggtgaagaagcctgggtcctcggtgaaagtctcttgcaaggcttctggaggccccttccgcagctatgctatcagctgggtgcgacaggcccctggacaagggcctgagtggatgggagggatcatccctatttttggtacaacaaaatacgcaccgaagttccagggcagagtcacgattaccgcggacgatttcgcgggcacagtttacatggagctgagcagcctgcgatctgaggacacggccatgtactactgtgcgaaacatatggggtaccaggtgcgcgaaactatggacgtctggggcaaagggaccacggtcaccgtctcgagcggtacgggcggttcaggcggaaccggcagcggcactggcgggtcgacgcagtctgtgttgacgcagccgccctcagtgtctgcggccccaggacagaaggtcaccatctcctgctctggaagcagctccaacattgggaatgattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccaactattactgcgcaacatgggatcgccgcccgactgcttatgttgtcttcggcggagggaccaagctgaccgtcctaggt

SEQ ID NO: 122 - protein, 249 aa, Artificial
  Synthetic Construct
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTQSVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLG

SEQ ID NO: 123 - DNA, 735 bp, Artificial
  SC06-262
  CDS (1)..(735)
caggtacagctgcagcagtcaggggctgaggtgaagaagcctgggtcctcggtgaaggtctcctgcaaggtttccggagtcattttcagcggcagtgcgatcagctgggtgcgacaggcccctggacaaggccttgagtggatgggagggatcagccctctctttggcacaacaaattacgcacaaaagttccagggcagagtcacgattaccgcggaccaatccacgaacacaacctacatggaggtgaacagcctgagatatgaggacacggccgtgtatttctgtgcgcgaggtccaaaatattacagtgagtacatggacgtctggggcaaagggaccacggtcaccgtctcgagcggtacgggcggttcaggcggaaccggcagcggcactggcgggtcgacggacatccagatgacccagtctccatcctccctgtctgcatctgtaggagacagagtcaccatcacttgccgggcgagtcagggcattagcagttatttagcctggtatcagcagaagccagggaaagttcctacactcctgatctatgatgcatccactttgcgatcaggggtcccatctcgcttcagtggcagtggatctgcgacagatttcactctcaccatcagcagcctgcagcctgaagatgttgcaacttattactgtcaaaggtataacagtgcccccccgatcaccttcggccaagggacacgactggagattaaacgt

SEQ ID NO: 124 - protein, 245 aa, Artificial
  Synthetic Construct
QVQLQQSGAEVKKPGSSVKVSCKVSGVIFSGSAISWVRQAPGQGLEWMGGISPLFGTTNYAQKFQGRVTITADQSTNTTYMEVNSLRYEDTAVYFCARGPKYYSEYMDVWGKGTTVTVSSGTGGSGGTGSGTGGSTDIQMTQSPSSLSASVGDRVTITCRASQGISSYLAWYQQKPGKVPTLLIYDASTLRSGVPSRFSGSGSATDFTLTISSLQPEDVATYYCQRYNSAPPITFGQGTRLEIKR

SEQ ID NO: 125 - DNA, 729 bp, Artificial
  SC06-268
  CDS (1)..(729)
caggtccagctggtacagtctggggctgaggtgaagaagcctgggtcctcggtgaaggtctcctgcaaggcttctggaggcaccttcagtagttatgctatcagctgggtgcgacaggcccctggacaagggcttgagtggatgggaggaatcatgggtatgtttggcacaactaactacgcacagaagttccagggcagagtcacgattaccgcggacgaattcacgagcgcagcctacatggagctgaggagcctgagatctgaggacacggccgtctactactgtgcgaggtctagtggttattaccccgaatacttccaggactggggccagggcaccctggtcaccgtctcgagcggtacgggcggttcaggcggaaccggcagcggcactggcgggtcgacgcagtctgtgctgactcagccaccctcagagtccgtgtccccaggacagacagccagcgtcacctgctctggacataaattgggggataaatatgtttcgtggtatcagcagaagccaggccagtcccctgtattactcatctatcaagataacaggcggccctcagggatccctgagcgattcataggctccaactctgggaacacagccactctgaccatcagcgggacccaggctctggatgaggctgactattactgtcaggcgtgggacagcagcactgcggttttcggcggagggaccaagctgaccgtcctaggt

SEQ ID NO: 126 - protein, 243 aa, Artificial
  Synthetic Construct
QVQLVQSGAEVKKPGSSVKVSCKASGGTFSSYAISWVRQAPGQGLEWMGGIMGMFGTTNYAQKFQGRVTITADEFTSAAYMELRSLRSEDTAVYYCARSSGYYPEYFQDWGQGTLVTVSSGTGGSGGTGSGTGGSTQSVLTQPPSESVSPGQTASVTCSGHKLGDKYVSWYQQKPGQSPVLLIYQDNRRPSGIPERFIGSNSGNTATLTISGTQALDEADYYCQAWDSSTAVFGGGTKLTVLG

SEQ ID NO: 127 - DNA, 738 bp, Artificial
  SC06-307
  CDS (1)..(738)
caggtccagctggtgcagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgtagactcagtgaagggccgattcaccatctccagagacaacgccaagaactcactgtatctgcaaatgaacagcctgagagccgaggacacggctgtgtattactgtgcgagaggtggtgggagctacggggcctacgaaggctttgactactggggccagggcaccctggtcaccgtctcgagcggtacgggcggttcaggcggaaccggcagcggcactggcgggtcgacggaaattgtgctgactcagtctccaggcaccctgtctttgtctccaggggaaagagccaccctctcctgcagggccagtcagcgtgttagcagctacttagcctggtaccaacagaaacctggccaggctcccaggctcctcatctatggtgcatccaccagggccgctggcatcccagacaggttcagtggcagtgggtctgggacagacttcactctcaccatcagcagactggagcctgaagattctgcagtgtattactgtcagcagtatggtaggacaccgctcactttcggcggagggaccaaggtggagatcaaacgt

SEQ ID NO: 128 - protein, 246 aa, Artificial
  Synthetic Construct
QVQLVQSGGGLVKPGGSLRLSCAASGFTFSSYSMNWVRQAPGKGLEWVSSISSSSSYIYYVDSVKGRFTISRDNAKNSLYLQMNSLRAEDTAVYYCARGGGSYGAYEGFDYWGQGTLVTVSSGTGGSGGTGSGTGGSTEIVLTQSPGTLSLSPGERATLSCRASQRVSSYLAWYQQKPGQAPRLLIYGASTRAAGIPDRFSGSGSGTDFTLTISRLEPEDSAVYYCQQYGRTPLTFGGGTKVEIKR

SEQ ID NO: 129 - DNA, 738 bp, Artificial
  SC06-310
  CDS (1)..(738)
gaggtgcagctggtggagtctggggctgaggtgaagaagcctgggtcctcggtgaaagtctcttgcaaggcttctggaggccccttccgcagctatgctatcagctgggtgcgacaggcccctggacaagggcctgagtggatgggagggatcatccctatttttggtacaacaaaatacgcaccgaagttccagggcagagtcacgattaccgcggacgatttcgcgggcacagtttacatggagctgagcagcctgcgatctgaggacacggccatgtactactgtgcgaaacatatggggtaccaggtgcgcgaaactatggacgtctggggcaaagggaccacggtcaccgtctcgagcggtacgggcggttcaggcggaaccggcagcggcactggcgggtcgacgtcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatgctgtgttcggaggaggcacccagctgaccgtcctcggt

SEQ ID NO: 130 - protein, 246 aa, Artificial
  Synthetic Construct
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTSYVLTQPPSVSVAPGQTARITCGGNNIGSKSVHWYQQKPGQAPVLVVYDDSDRPSGIPERFSGSNSGNTATLTISRVEAGDEADYYCQVWDSSSDHAVFGGGTQLTVLG

SEQ ID NO: 131 - DNA, 744 bp, Artificial
  SC06-314
  CDS (1)..(744)
gaggtgcagctggtggagtctggggctgaggtgaagaagcctgggtcctcggtgaaagtctcttgcaaggcttctggaggccccttccgcagctatgctatcagctgggtgcgacaggcccctggacaagggcctgagtggatgggagggatcatccctatttttggtacaacaaaatacgcaccgaagttccagggcagagtcacgattaccgcggacgatttcgcgggcacagtttacatggagctgagcagcctgcgatctgaggacacggccatgtactactgtgcgaaacatatggggtaccaggtgcgcgaaactatggacgtctggggcaaagggaccacggtcaccgtctcgagcggtacgggcggttcaggcggaaccggcagcggcactggcgggtcgacgtcctatgtgctgactcagccaccctcagcgtctgggacccccgggcagagggtcaccatctcttgttctggaagcagctccaacatcggaagtaattatgtatactggtaccagcagctcccaggcacggcccccaaactcctcatctatagggatggtcagcggccctcaggggtccctgaccgattctctggctccaagtctggcacctcagcctccctggccatcagtggactccggtccgatgatgaggctgattattactgtgcaacatgggatgacaacctgagtggtccagtattcggcggagggaccaagctgaccgtcctaggt

SEQ ID NO: 132 - protein, 248 aa, Artificial
  Synthetic Construct
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTSYVLTQPPSASGTPGQRVTISCSGSSSNIGSNYVYWYQQLPGTAPKLLIYRDGQRPSGVPDRFSGSKSGTSASLAISGLRSDDEADYYCATWDDNLSGPVFGGGTKLTVLG

SEQ ID NO: 133 - DNA, 735 bp, Artificial
  SC06-323
  CDS (1)..(735)
gaggtgcagctggtggagtctggggctgaggtgaagaagccagggtcctcggtgaaggtctcctgtaaggcctctggaggcaccttctccagctatggtatcagctgggtgcgacaggcccctggacaagggcttgagtggatgggagacatcatcggtatgtttggttcaacaaactacgcacagaacttccagggcagactcacgattaccgcggacgaatccacgagcacagcctacatggagctgagcagcctgagatctgaggacacggccgtgtattactgtgcgagaagtagtggttattaccctgcatacctcccccactggggccagggcaccttggtcaccgtctcgagcggtacgggcggttcaggcggaaccggcagcggcactggcgggtcgacggaaattgtgttgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacccagaactttcggcggagggaccaaggtggagatcaaacgt

SEQ ID NO: 134 - protein, 245 aa, Artificial
  Synthetic Construct
EVQLVESGAEVKKPGSSVKVSCKASGGTFSSYGISWVRQAPGQGLEWMGDIIGMFGSTNYAQNFQGRLTITADESTSTAYMELSSLRSEDTAVYYCARSSGYYPAYLPHWGQGTLVTVSSGTGGSGGTGSGTGGSTEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGGGTKVEIKR

SEQ ID NO: 135 - DNA, 744 bp, Artificial
  SC06-325
  CDS (1)..(744)
gaggtgcagctggtggagtctggggctgaggtgaagaagccggggtcctcggtgaaggtctcctgcaaggcttctggaggcaccttcagcttctattctatgagctgggtgcgacaggcccctggacaaggacttgagtggatgggagggatcatccctatgtttggtacaacaaactacgcacagaagttccagggcagagtcacgattaccgcggtcgaatccacgagcacagcctacatggaggtgagcagcctgagatctgaggacacggccgtttattactgtgcgagaggtgataagggtatctactactactacatggacgtctggggcaaagggaccacggtcaccgtctcgagcggtacgggcggttcaggcggaaccggcagcggcactggcgggtcgacgcagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactcttgtcttcggaactgggaccaaggtcaccgtcctaggt

SEQ ID NO: 136 - protein, 248 aa, Artificial
  Synthetic Construct
EVQLVESGAEVKKPGSSVKVSCKASGGTFSFYSMSWVRQAPGQGLEWMGGIIPMFGTTNYAQKFQGRVTITAVESTSTAYMEVSSLRSEDTAVYYCARGDKGIYYYYMDVWGKGTTVTVSSGTGGSGGTGSGTGGSTQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKVTVLG

SEQ ID NO: 137 - DNA, 735 bp, Artificial
  SC06-331
  CDS (1)..(735)
gaggtgcagctggtggagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatcggtatgttcggtacagcaaactacgcacagaagttccagggcagagtcacgattaccgcggacgaatttacgagcacagcctacatggagctgagcagcctgagatctgaggacacggccgtgtattactgtgcgagaggaaattattactatgagagtagtctcgactactggggccagggaaccctggtcaccgtctcgagcggtacgggcggttcaggcggaaccggcagcggcactggcgggtcgacgcagtctgtcgtgacgcagccgccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcattatgtcttcggaactgggaccaaggtcaccgtcctaggt

SEQ ID NO: 138 - protein, 245 aa, Artificial
  Synthetic Construct
EVQLVESGAEVKKPGSSVKVSCKASGGTFSSYAISWVRQAPGQGLEWMGGIIGMFGTANYAQKFQGRVTITADEFTSTAYMELSSLRSEDTAVYYCARGNYYYESSLDYWGQGTLVTVSSGTGGSGGTGSGTGGSTQSVVTQPPSVSVAPGQTARITCGGNNIGSKSVHWYQQKPGQAPVLVVYDDSDRPSGIPERFSGSNSGNTATLTISRVEAGDEADYYCQVWDSSSDHYVFGTGTKVTVLG

SEQ ID NO: 139 - DNA, 750 bp, Artificial
  SC06-344
  CDS (1)..(750)
caggtgcagctggtgcagtctggggctgaggtgaagaagcctgggtcctcggtgagagtctcctgcaaggcttctggaagcatcttcagaaactatgctatgagctgggtgcgacaggcccctggacaagggcttgagtggatgggagggatcatcgctatttttgggacaccaaagtacgcacagaagttccagggcagagtcacgattaccgcggacgaatcgacgagcactgtctacatggaactgagcggactgagatctgaggacacggccatgtattactgtgcgaggattccccactataattttggttcggggagttatttcgactactggggccagggaaccctggtcaccgtctcgagcggtacgggcggttcaggcggaaccggcagcggcactggcgggtcgacgactgtgttgacacagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacgtcagccaccctgggcatcaccggactccagactggggacgaggccgattattactgcggaacatgggatagcagcctgagtgcttatgtcttcggaactgggaccaaggtcaccgtcctaggt

SEQ ID NO: 140 - protein, 250 aa, Artificial
  Synthetic Construct
QVQLVQSGAEVKKPGSSVRVSCKASGSIFRNYAMSWVRQAPGQGLEWMGGIIAIFGTPKYAQKFQGRVTITADESTSTVYMELSGLRSEDTAMYYCARIPHYNFGSGSYFDYWGQGTLVTVSSGTGGSGGTGSGTGGSTTVLTQPPSVSGAPGQRVTISCTGSSSNIGAGYDVHWYQQLPGTAPKLLIYGNSNRPSGVPDRFSGSKSGTSATLGITGLQTGDEADYYCGTWDSSLSAYVFGTGTKVTVLG

SEQ ID NO: 141 - DNA, 10515 bp, Artificial
  Vector pIg-C911-HCgamma1
  misc_feature (1326)..(5076): Stuffer
tcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagctggcctggatatcctgactctcttaggtagccttgcagaagttggtcgtgaggcactgggcaggtaagtatcaaggttacaagacaggtttaaggagatcaatagaaactgggcttgtcgagacagagaagactcttgcgtttctgataggcacctattggtcttactgacatccactttgcctttctctccacaggtgtccactcccagttcaattacagctcgccaccatgggatggagctgtatcatcctcttcttggtactgctgctggcccagccggccagtgaccttgaccggtgcaccacttttgatgatgttcaagctcctaattacactcaacatacttcatctatgaggggggtttactatcctgatgaaatttttagatcggacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaggcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgattttggcgacatttcaggcattaacgcttctgtcgtcaacattcaaaaagaaattgaccgcctcaatgaggtcgctaaaaatttaaatgaatcactcattgaccttcaagaactgggaaaatatgagcaatatattaaatggcctctcgacgaacaaaaactcatctcagaagaggatctgaatgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttaggcggccgctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaagtgataatctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacg

SEQ ID NO: 142 - DNA, 8777 bp, Artificial
  Vector pIg-C909-Ckappa
  misc_feature (1328)..(3860): Stuffer
tcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgttaattaacatgaagaatctgcttagggttaggcgttttgcgctgcttcgctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaatcgatgactctcttaggtagccttgcagaagttggtcgtgaggcactgggcaggtaagtatcaaggttacaagacaggtttaaggagatcaatagaaactgggcttgtcgagacagagaagactcttgcgtttctgataggcacctattggtcttactgacatccactttgcctttctctccacaggtgtccactcccagttcaattacagctcgccaccatgcggctgcccgcccagctgctgggccttctcatgctgtgggtgcccgcctcgagatctatcgatgcatgccatggtaccaagcttgccaccatgagcagcagctcttggctgctgctgagcctggtggccgtgacagccgcccagagcaccatcgaggagcaggccaagaccttcctggacaagttcaaccacgaggccgaggacctgttctaccagagcagcctggccagctggaactacaacaccaacatcaccgaggagaacgtgcagaacatgaacaacgccggcgacaagtggagcgccttcctgaaggagcagagcacactggcccagatgtaccccctgcaggagatccagaacctgaccgtgaagctgcagctgcaggccctgcagcagaacggcagcagcgtgctgagcgaggacaagagcaagcggctgaacaccatcctgaacaccatgtccaccatctacagcaccggcaaagtgtgcaaccccgacaacccccaggagtgcctgctgctggagcccggcctgaacgagatcatggccaacagcctggactacaacgagcggctgtgggcctgggagagctggcggagcgaagtgggcaagcagctgcggcccctgtacgaggagtacgtggtgctgaagaacgagatggccagggccaaccactacgaggactacggcgactactggagaggcgactacgaagtgaacggcgtggacggctacgactacagcagaggccagctgatcgaggacgtggagcacaccttcgaggagatcaagcctctgtacgagcacctgcacgcctacgtgcgggccaagctgatgaacgcctaccccagctacatcagccccatcggctgcctgcccgcccacctgctgggcgacatgtggggccggttctggaccaacctgtacagcctgaccgtgcccttcggccagaagcccaacatcgacgtgaccgacgccatggtggaccaggcctgggacgcccagcggatcttcaaggaggccgagaagttcttcgtgagcgtgggcctgcccaacatgacccagggcttttgggagaacagcatgctgaccgaccccggcaatgtgcagaaggccgtgtgccaccccaccgcctgggacctgggcaagggcgacttccggatcctgatgtgcaccaaagtgaccatggacgacttcctgaccgcccaccacgagatgggccacatccagtacgacatggcctacgccgcccagcccttcctgctgcggaacggcgccaacgagggctttcacgaggccgtgggcgagatcatgagcctgagcgccgccacccccaagcacctgaagagcatcggcctgctgagccccgacttccaggaggacaacgagaccgagatcaacttcctgctgaagcaggccctgaccatcgtgggcaccctgcccttcacctacatgctggagaagtggcggtggatggtgtttaagggcgagatccccaaggaccagtggatgaagaagtggtgggagatgaagcgggagatcgtgggcgtggtggagcccgtgccccacgacgagacctactgcgaccccgccagcctgttccacgtgagcaacgactactccttcatccggtactacacccggaccctgtaccagttccagttccaggaggccctgtgccaggccgccaagcacgagggccccctgcacaagtgcgacatcagcaacagcaccgaggccggacagaaactgttcaacatgctgcggctgggcaagagcgagccctggaccctggccctggagaatgtggtgggcgccaagaacatgaatgtgcgccccctgctgaactacttcgagcccctgttcacctggctgaaggaccagaacaagaacagcttcgtgggctggagcaccgactggagcccctacgccgaccagagcatcaaagtgcggatcagcctgaagagcgccctgggcgacaaggcctacgagtggaacgacaacgagatgtacctgttccggagcagcgtggcctatgccatgcggcagtacttcctgaaagtgaagaaccagatgatcctgttcggcgaggaggacgtgagagtggccaacctgaagccccggatcagcttcaacttcttcgtgaccgcccccaagaacgtgagcgacatcatcccccggaccgaagtggagaaggccatccggatgagccggagccggatcaacgacgccttccggctgaacgacaactccctggagttcctgggcatccagcccaccctgggccctcccaaccagccccccgtgagcatctggctgatcgtgtttggcgtggtgatgggcgtgatcgtggtgggaatcgtgatcctgatcttcaccggcatccgggaccggaagaagaagaacaaggcccggagcggcgagaacccctacgccagcatcgatatcagcaagggcgagaacaaccccggcttccagaacaccgacgacgtgcagaccagcttctgataatctagaacgagctcgaattcgaagcttctgcagacgcgtcgacgtcatatggatccgatatcgccgtggcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgttaatagacttaagtttaaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggccatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccacaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagcacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacg

SEQ ID NO: 143 - DNA, 8792 bp, Artificial
  Vector pIg-C910-Clambda
  misc_feature (1330)..(3869): Stuffer
tcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgttaattaacatgaagaatctgcttagggttaggcgttttgcgctgcttcgctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaatcgatgactctcttaggtagccttgcagaagttggtcgtgaggcactgggcaggtaagtatcaaggttacaagacaggtttaaggagatcaatagaaactgggcttgtcgagacagagaagactcttgcgtttctgataggcacctattggtcttactgacatccactttgcctttctctccacaggtgtccactcccagttcaattacagctcgccaccatgcggttctccgctcagctgctgggccttctggtgctgtggattcccggcgtctcgagatctatcgatgcatgccatggtaccaagcttgccaccatgagcagcagctcttggctgctgctgagcctggtggccgtgacagccgcccagagcaccatcgaggagcaggccaagaccttcctggacaagttcaaccacgaggccgaggacctgttctaccagagcagcctggccagctggaactacaacaccaacatcaccgaggagaacgtgcagaacatgaacaacgccggcgacaagtggagcgccttcctgaaggagcagagcacactggcccagatgtaccccctgcaggagatccagaacctgaccgtgaagctgcagctgcaggccctgcagcagaacggcagcagcgtgctgagcgaggacaagagcaagcggctgaacaccatcctgaacaccatgtccaccatctacagcaccggcaaagtgtgcaaccccgacaacccccaggagtgcctgctgctggagcccggcctgaacgagatcatggccaacagcctggactacaacgagcggctgtgggcctgggagagctggcggagcgaagtgggcaagcagctgcggcccctgtacgaggagtacgtggtgctgaagaacgagatggccagggccaaccactacgaggactacggcgactactggagaggcgactacgaagtgaacggcgtggacggctacgactacagcagaggccagctgatcgaggacgtggagcacaccttcgaggagatcaagcctctgtacgagcacctgcacgcctacgtgcgggccaagctgatgaacgcctaccccagctacatcagccccatcggctgcctgcccgcccacctgctgggcgacatgtggggccggttctggaccaacctgtacagcctgaccgtgcccttcggccagaagcccaacatcgacgtgaccgacgccatggtggaccaggcctgggacgcccagcggatcttcaaggaggccgagaagttcttcgtgagcgtgggcctgcccaacatgacccagggcttttgggagaacagcatgctgaccgaccccggcaatgtgcagaaggccgtgtgccaccccaccgcctgggacctgggcaagggcgacttccggatcctgatgtgcaccaaagtgaccatggacgacttcctgaccgcccaccacgagatgggccacatccagtacgacatggcctacgccgcccagcccttcctgctgcggaacggcgccaacgagggctttcacgaggccgtgggcgagatcatgagcctgagcgccgccacccccaagcacctgaagagcatcggcctgctgagccccgacttccaggaggacaacgagaccgagatcaacttcctgctgaagcaggccctgaccatcgtgggcaccctgcccttcacctacatgctggagaagtggcggtggatggtgtttaagggcgagatccccaaggaccagtggatgaagaagtggtgggagatgaagcgggagatcgtgggcgtggtggagcccgtgccccacgacgagacctactgcgaccccgccagcctgttccacgtgagcaacgactactccttcatccggtactacacccggaccctgtaccagttccagttccaggaggccctgtgccaggccgccaagcacgagggccccctgcacaagtgcgacatcagcaacagcaccgaggccggacagaaactgttcaacatgctgcggctgggcaagagcgagccctggaccctggccctggagaatgtggtgggcgccaagaacatgaatgtgcgccccctgctgaactacttcgagcccctgttcacctggctgaaggaccagaacaagaacagcttcgtgggctggagcaccgactggagcccctacgccgaccagagcatcaaagtgcggatcagcctgaagagcgccctgggcgacaaggcctacgagtggaacgacaacgagatgtacctgttccggagcagcgtggcctatgccatgcggcagtacttcctgaaagtgaagaaccagatgatcctgttcggcgaggaggacgtgagagtggccaacctgaagccccggatcagcttcaacttcttcgtgaccgcccccaagaacgtgagcgacatcatcccccggaccgaagtggagaaggccatccggatgagccggagccggatcaacgacgccttccggctgaacgacaactccctggagttcctgggcatccagcccaccctgggccctcccaaccagccccccgtgagcatctggctgatcgtgtttggcgtggtgatgggcgtgatcgtggtgggaatcgtgatcctgatcttcaccggcatccgggaccggaagaagaagaacaaggcccggagcggcgagaacccctacgccagcatcgatatcagcaagggcgagaacaaccccggcttccagaacaccgacgacgtgcagaccagcttctgataatctagaacgagctcgaattcgaagcttctgcagacgcgtcgacgtcatatggatccgatatcgccgtggcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagctaatagacttaagtttaaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggccatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagcacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacg

SEQ ID NO: 144 - DNA, 23 bp, Artificial
  Primer OK1 (HuVK1B)
gacatccagwtgacccagtctcc

SEQ ID NO: 145 - DNA, 23 bp, Artificial
  Primer OK2 (HuVK2)
gatgttgtgatgactcagtctcc

SEQ ID NO: 146 - DNA, 23 bp, Artificial
  Primer OK3 (HuVK2B2)
gatattgtgatgacccagactcc

SEQ ID NO: 147 - DNA, 23 bp, Artificial
  Primer OK4 (HuVK3B)
gaaattgtgwtgacrcagtctcc

SEQ ID NO: 148 - DNA, 23 bp, Artificial
  Primer OK5 (HuVK5)
gaaacgacactcacgcagtctcc

SEQ ID NO: 149 - DNA, 23 bp, Artificial
  Primer OK6 (HuVK6)
gaaattgtgctgactcagtctcc

SEQ ID NO: 150 - DNA, 24 bp, Artificial
  Primer OCK (HuCK)
acactctcccctgttgaagctctt

SEQ ID NO: 151 - DNA, 23 bp, Artificial
  Primer OL1 (HuVL1A)
cagtctgtgctgactcagccacc

SEQ ID NO: 152 - DNA, 23 bp, Artificial
  Primer OL1 (HuVL1B)
cagtctgtgytgacgcagccgcc

SEQ ID NO: 153 - DNA, 23 bp, Artificial
  Primer OL1 (HuVL1C)
cagtctgtcgtgacgcagccgcc

SEQ ID NO: 154 - DNA, 20 bp, Artificial
  OL2 (HuVL2B)
cagtctgccctgactcagcc

SEQ ID NO: 155 - DNA, 23 bp, Artificial
  OL3 (HuVL3A)
tcctatgwgctgactcagccacc

SEQ ID NO: 156 - DNA, 23 bp, Artificial
  OL4 (HuVL3B)
tcttctgagctgactcaggaccc

SEQ ID NO: 157 - DNA, 20 bp, Artificial
  OL5 (HuVL4B)
cagcytgtgctgactcaatc

SEQ ID NO: 158 - DNA, 23 bp, Artificial
  OL6 (HuVL5)
caggctgtgctgactcagccgtc

SEQ ID NO: 159 - DNA, 23 bp, Artificial
  OL7 (HuVL6)
aattttatgctgactcagcccca

SEQ ID NO: 160 - DNA, 23 bp, Artificial
  OL8 (HuVL7/8)
cagrctgtggtgacycaggagcc

SEQ ID NO: 161 - DNA, 23 bp, Artificial
  OL9 (HuVL9)
cwgcctgtgctgactcagccmcc

SEQ ID NO: 162 - DNA, 18 bp, Artificial
  OL9 (HuVL10)
caggcagggctgactcag

SEQ ID NO: 163 - DNA, 23 bp, Artificial
  OCL (HuCL2)
tgaacattctgtaggggccactg

SEQ ID NO: 164 - DNA, 23 bp, Artificial
  OCL (HuCL7)
agagcattctgcaggggccactg

SEQ ID NO: 165 - DNA, 23 bp, Artificial
  OH1(HuVH1B7A)
cagrtgcagctggtgcartctgg

SEQ ID NO: 166 - DNA, 23 bp, Artificial
  OH1 (HuVH1C)
saggtccagctggtrcagtctgg

SEQ ID NO: 167 - DNA, 23 bp, Artificial
  OH2 (HuVH2B)
cagrtcaccttgaaggagtctgg

SEQ ID NO: 168 - DNA, 18 bp, Artificial
  OH3 (HuVH3A)
gaggtgcagctggtggag

SEQ ID NO: 169 - DNA, 23 bp, Artificial
  OH4 (HuVH3C)
gaggtgcagctggtggagwcygg

SEQ ID NO: 170 - DNA, 23 bp, Artificial
  OH5 (HuVH4B)
caggtgcagctacagcagtgggg

SEQ ID NO: 171 - DNA, 23 bp, Artificial
  OH6 (HuVH4C)
cagstgcagctgcaggagtcsgg

SEQ ID NO: 172 - DNA, 23 bp, Artificial
  OH7 (HuVH6A)
caggtacagctgcagcagtcagg

SEQ ID NO: 173 - DNA, 24 bp, Artificial
  OCM (HuCIgM)
tggaagaggcacgttcttttcttt

SEQ ID NO: 174 - DNA, 41 bp, Artificial
  OK1S (HuVK1B-SAL)
tgagcacacaggtcgacggacatccagwtgacccagtctcc

SEQ ID NO: 175 - DNA, 41 bp, Artificial
  OK2S (HuVK2-SAL)
tgagcacacaggtcgacggatgttgtgatgactcagtctcc

SEQ ID NO: 176 - DNA, 41 bp, Artificial
  OK3S (HuVK2B2-SAL)
tgagcacacaggtcgacggatattgtgatgacccagactcc

SEQ ID NO: 177 - DNA, 41 bp, Artificial
  OK4S (HuVK3B-SAL)
tgagcacacaggtcgacggaaattgtgwtgacrcagtctcc

SEQ ID NO: 178 - DNA, 41 bp, Artificial
  OK5S (HuVK5-SAL)
tgagcacacaggtcgacggaaacgacactcacgcagtctcc

SEQ ID NO: 179 - DNA, 41 bp, Artificial
  OK6S (HuVK6-SAL)
tgagcacacaggtcgacggaaattgtgctgactcagtctcc

SEQ ID NO: 180 - DNA, 48 bp, Artificial
  OJK1 (HuJK1-NOT)
gagtcattctcgacttgcggccgcacgtttgatttccaccttggtccc

SEQ ID NO: 181 - DNA, 48 bp, Artificial
  OJK2 (HuJK2-NOT)
gagtcattctcgacttgcggccgcacgtttgatctccagcttggtccc

SEQ ID NO: 182 - DNA, 48 bp, Artificial
  OJK3 (HuJK3-NOT)
gagtcattctcgacttgcggccgcacgtttgatatccactttggtccc

SEQ ID NO: 183 - DNA, 48 bp, Artificial
  OJK4 (HuJK4-NOT)
gagtcattctcgacttgcggccgcacgtttgatctccaccttggtccc

SEQ ID NO: 184 - DNA, 48 bp, Artificial
  OJK5 (HuJK5-NOT)
gagtcattctcgacttgcggccgcacgtttaatctccagtcgtgtccc

SEQ ID NO: 185 - DNA, 41 bp, Artificial
  OL1S (HuVL1A-SAL)
tgagcacacaggtcgacgcagtctgtgctgactcagccacc

SEQ ID NO: 186 - DNA, 41 bp, Artificial
  OL1S (HuVL1B-SAL)
tgagcacacaggtcgacgcagtctgtgytgacgcagccgcc

SEQ ID NO: 187 - DNA, 41 bp, Artificial
  OL1S (HuVL1C-SAL)
tgagcacacaggtcgacgcagtctgtcgtgacgcagccgcc

SEQ ID NO: 188 - DNA, 38 bp, Artificial
  OL2S (HuVL2B-SAL)
tgagcacacaggtcgacgcagtctgccctgactcagcc

SEQ ID NO: 189 - DNA, 41 bp, Artificial
  OL3S (HuVL3A-SAL)
tgagcacacaggtcgacgtcctatgwgctgactcagccacc

SEQ ID NO: 190 - DNA, 41 bp, Artificial
  OL4S (HuVL3B-SAL)
tgagcacacaggtcgacgtcttctgagctgactcaggaccc

SEQ ID NO: 191 - DNA, 38 bp, Artificial
  OL5S (HuVL4B-SAL)
tgagcacacaggtcgacgcagcytgtgctgactcaatc

SEQ ID NO: 192 - DNA, 41 bp, Artificial
  OL6S (HuVL5-SAL)
tgagcacacaggtcgacgcaggctgtgctgactcagccgtc

SEQ ID NO: 193 - DNA, 41 bp, Artificial
  OL7S (HuVL6-SAL)
tgagcacacaggtcgacgaattttatgctgactcagcccca

SEQ ID NO: 194 - DNA, 41 bp, Artificial
  OL8S (HuVL7/8-SAL)
tgagcacacaggtcgacgcagrctgtggtgacycaggagcc

SEQ ID NO: 195 - DNA, 41 bp, Artificial
  OL9S (HuVL9-SAL)
tgagcacacaggtcgacgcwgcctgtgctgactcagccmcc

SEQ ID NO: 196 - DNA, 36 bp, Artificial
  OL9S (HuVL10-SAL)
tgagcacacaggtcgacgcaggcagggctgactcag

SEQ ID NO: 197 - DNA, 48 bp, Artificial
  OJL1 (HuJL1-NOT)
gagtcattctcgacttgcggccgcacctaggacggtgaccttggtccc

SEQ ID NO: 198 - DNA, 48 bp, Artificial
  OJL2 (HuJL2/3-NOT)
gagtcattctcgacttgcggccgcacctaggacggtcagcttggtccc

SEQ ID NO: 199 - DNA, 48 bp, Artificial
  OJL3 (HuJL7-NOT)
gagtcattctcgacttgcggccgcaccgaggacggtcagctgggtgcc

SEQ ID NO: 200 - DNA, 56 bp, Artificial
  OH1S (HuVH1B-SFI)
gtcctcgcaactgcggcccagccggccatggcccagrtgcagctggtgcartctgg

SEQ ID NO: 201 - DNA, 56 bp, Artificial
  OH1S (HuVH1C-SFI)
gtcctcgcaactgcggcccagccggccatggccsaggtccagctggtrcagtctgg

SEQ ID NO: 202 - DNA, 56 bp, Artificial
  OH2S (HuVH2B-SFI)
gtcctcgcaactgcggcccagccggccatggcccagrtcaccttgaaggagtctgg

SEQ ID NO: 203 - DNA, 51 bp, Artificial
  OH3S (HuVH3A-SFI)
gtcctcgcaactgcggcccagccggccatggccgaggtgcagctggtggag

SEQ ID NO: 204 - DNA, 56 bp, Artificial
  OH4S (HuVH3C-SFI)
gtcctcgcaactgcggcccagccggccatggccgaggtgcagctggtggagwcygg

SEQ ID NO: 205 - DNA, 56 bp, Artificial
  OH5S (HuVH4B-SFI)
gtcctcgcaactgcggcccagccggccatggcccaggtgcagctacagcagtgggg

SEQ ID NO: 206 - DNA, 56 bp, Artificial
  OH6S (HuVH4C-SFI)
gtcctcgcaactgcggcccagccggccatggcccagstgcagctgcaggagtcsgg

SEQ ID NO: 207 - DNA, 56 bp, Artificial
  OH7S (HuVH6A-SFI)
gtcctcgcaactgcggcccagccggccatggcccaggtacagctgcagcagtcagg

SEQ ID NO: 208 - DNA, 36 bp, Artificial
  OJH1 (HuJH1/2-XHO)
gagtcattctcgactcgagacrgtgaccagggtgcc

SEQ ID NO: 209 - DNA, 36 bp, Artificial
  OJH2 (HuJH3-XHO)
gagtcattctcgactcgagacggtgaccattgtccc

SEQ ID NO: 210 - DNA, 36 bp, Artificial
  OJH3 (HuJH4/5-XHO)
gagtcattctcgactcgagacggtgaccagggttcc

SEQ ID NO: 211 - DNA, 36 bp, Artificial
  OJH4 (HuJH6-XHO)
gagtcattctcgactcgagacggtgaccgtggtccc

SEQ ID NO: 212 - DNA, 735 bp, Artificial
  SC06-141
  CDS (1)..(735)
gaggtccagctggtgcagtctggggctgaggtgaagaagcctggggcctcagtgaaggtctcctgcaaggcttctgggtacaccttcaccggctactatgtgtactgggtgcgacaggcccctggacaagggcttgagtggatgggatggatcagcgcttacaatggtaacacaaactatgcacagaagttccagggcagagtcacgattaccgcggacaaatccacgagcacagcctacatggagctgagcagcctgagatctgaagacacggctgtgtattactgtgcgagaagtagatccctggacgtctggggccaagggaccacggtcaccgtctcgagcggtacgggcggttcaggcggaaccggcagcggcactggcgggtcgacggatgttgtgatgactcagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctctcactttcggcggagggaccaaagtggatatcaaacgt

SEQ ID NO: 213 - protein, 245 aa, Artificial
  Synthetic Construct
EVQLVQSGAEVKKPGASVKVSCKASGYTFTGYYVYWVRQAPGQGLEWMGWISAYNGNTNYAQKFQGRVTITADKSTSTAYMELSSLRSEDTAVYYCARSRSLDVWGQGTTVTVSSGTGGSGGTGSGTGGSTDVVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVDIKR

SEQ ID NO: 214 - DNA, 741 bp, Artificial
  SC06-272
  CDS (1)..(741)
cagatgcagctggtgcagtctggggctgaggtgaagaagcctgggtcctcggtgaaggtctcctgcaaggcttctggaggcaccttctccagttatgctatcacctgggtgcgacaggcccctggacaagggcttgagtggatgggagggatcatcggtatgtttggttcaacaaactacgcacagaacttccagggcagagtcacgattaccgcggacgaatccacgagcacagcctacatggagctgagcagcctcagatctgaggacacggccgtgtattactgtgcgagaagtactggttattaccctgcatacctccaccactggggccagggcaccctggtcaccgtctcgagcggtacgggcggttcaggcggaaccggcagcggcactggcgggtcgacgcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgcagctcatatacaagcagcagcactcatgtcttcggaactgggaccaaggtcaccgtcctaggt

SEQ ID NO: 215 - protein, 247 aa, Artificial
  Synthetic Construct
QMQLVQSGAEVKKPGSSVKVSCKASGGTFSSYAITWVRQAPGQGLEWMGGIIGMFGSTNYAQNFQGRVTITADESTSTAYMELSSLRSEDTAVYYCARSTGYYPAYLHHWGQGTLVTVSSGTGGSGGTGSGTGGSTQSALTQPRSVSGSPGQSVTISCTGTSSDVGGYNYVSWYQQHPGKAPKLMIYDVSKRPSGVPDRFSGSKSGNTASLTISGLQAEDEADYYCSSYTSSSTHVFGTGTKVTVLG

SEQ ID NO: 216 - DNA, 738 bp, Artificial
  SC06-296
  CDS (1)..(738)
gaggtgcagctggtggagaccggggctgaggtgaagaagcctggggcctcagtgaaggtttcctgcaaggcatctggatacaccttcaccagctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagaggggaaatggggacctcaagcggcttttgatatctggggccaagggacaatggtcaccgtctcgagcggtacgggcggttcaggcggaaccggcagcggcactggcgggtcgacggaaattgtgatgacgcagtctccaggcaccctgtctttgtctccaggggaaagagccaccctctcctgcagggccagtcagagtgttagcagcagctacttagcctggtaccagcagaaacctggccaggctcccaggctcctcatctatgatgcatccagcagggccactgacatcccagacaggttcagtggcagtgggtctgggacagacttcactctcaccatcagcagactggagcctgaagattttgcagtgtattactgtcagcagtatggtagctcactttggacgttcggccaagggaccaaggtggagatcaaacgt

SEQ ID NO: 217 - protein, 246 aa, Artificial
  Synthetic Construct
EVQLVETGAEVKKPGASVKVSCKASGYTFTSYYMHWVRQAPGQGLEWMGWINPNSGGTNYAQKFQGRVTMTRDTSISTAYMELSRLRSDDTAVYYCAREGKWGPQAAFDIWGQGTMVTVSSGTGGSGGTGSGTGGSTEIVMTQSPGTLSLSPGERATLSCRASQSVSSSYLAWYQQKPGQAPRLLIYDASSRATDIPDRFSGSGSGTDFTLTISRLEPEDFAVYYCQQYGSSLWTFGQGTKVEIKR

SEQ ID NO: 218 - DNA, 738 bp, Artificial
  SC06-301
  CDS (1)..(738)
gaggtgcagctggtagagtctgggggaggcttggtacagcctggggggtccctgagactctcctgtgcagcctctggattcacctttagcatctatgccatgagctgggtccgccaggcaccagggaaggggctggagtgggtctcagctattagtagtagtggtgatagcacatactacgcagactccgtgaagggccggttcaccatctccagagacaacgccaggaacacgctgtatctgcaaatgaacagtctgagagccgaggacacggctgtgtattactgtgcgagagcgtatggctacacgttcgacccctggggccagggaaccctggtcaccgtctcgagcggtacgggcggttcaggcggaaccggcagcggcactggcgggtcgacggaaattgtgctgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcccctcactttcggcggagggaccaaggtggagatcaaacgt

SEQ ID NO: 219 - protein, 246 aa, Artificial
  Synthetic Construct
EVQLVESGGGLVQPGGSLRLSCAASGFTFSIYAMSWVRQAPGKGLEWVSAISSSGDSTYYADSVKGRFTISRDNARNTLYLQMNSLRAEDTAVYYCARAYGYTFDPWGQGTLVTVSSGTGGSGGTGSGTGGSTEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIKR

SEQ ID NO: 220 - DNA, 738 bp, Artificial
  SC06-327
  CDS (1)..(738)
gaggtgcagctggtggagaccggggctgaggtgaagaagcctgggtcctcggtgaaggtctcctgcaaggcctctggaggcaccttcaggacccatgctatcagttgggtgcgacaggcccctggacaagggcttgagtggatgggagggatcatcgctatcttcggaacagcaaactacgcacagaagttccagggcagaatcacgattaccgcggacgaatccacgagtacagcctacatggagctgagcagcctgagatctgaggacacggccgtgtatttctgtgcgagaggcagtggttatcatatatcgacaccctttgacaactggggccagggaaccctggtcaccgtctcgagcggtacgggcggttcaggcggaaccggcagcggcactggcgggtcgacgtcctatgtgctgactcagccaccctcggtgtcagtggccccaggacagacggccaggattacctgtgggggaaacaacattggaagtaaaggtgtgcactggtaccagcagaagcctggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatgtggtattcggcggagggaccaagctgaccgtcctaggt

SEQ ID NO: 221 - protein, 246 aa, Artificial
  Synthetic Construct
EVQLVETGAEVKKPGSSVKVSCKASGGTFRTHAISWVRQAPGQGLEWMGGIIAIFGTANYAQKFQGRITITADESTSTAYMELSSLRSEDTAVYFCARGSGYHISTPFDNWGQGTLVTVSSGTGGSGGTGSGTGGSTSYVLTQPPSVSVAPGQTARITCGGNNIGSKGVHWYQQKPGQAPVLVVYDDSDRPSGIPERFSGSNSGNTATLTISRVEAGDEADYYCQVWDSSSDHVVFGGGTKLTVLG

SEQ ID NO: 222 - DNA, 756 bp, Artificial
  SC06-328
  CDS (1)..(756)
gaggtgcagctggtggagtctggggctgaggtgaagaagcctgggtcctcggtgaaggtctcctgcaaggcttctggacacatcttcagcggctatgcaatcagttgggtgcgacaggcccctggacaagggcttgagtggatgggagggatcatccctatctttggtacaacaaactacgcacagaagttccagggcagagtcacgattaccgcggaccaatccacgagcacagcctacatggacctgagcaacttgagatctgaggacacggccgtctattactgtgcgagagtgaaagatggatattgtactcttaccagctgccctgtcggctggtacttcgatctctggggccgtggcaccctggtcactgtctcgagcggtacgggcggttcaggcggaaccggcagcggcactggcgggtcgacggaaattgtgatgacgcagtctccaggcaccctgtctttgtctccaggggaaagagccaccctctcgtgcagggccagtcagagtgttagcagcagctacttagcctggtaccagcagaaacctggccaggctcccaggctcctcatctttggtgcctccagcagggccactggcatcccagacaggttcagtggcagtgggtctgggacagacttcactctcaccatcagcagactggagcctgaagattttgcagtgtattactgtcagcagtatggtagctcactcactttcggcggagggaccaagctggagatcaaacgt

SEQ ID NO: 223 - protein, 252 aa, Artificial
  Synthetic Construct
EVQLVESGAEVKKPGSSVKVSCKASGHIFSGYAISWVRQAPGQGLEWMGGIIPIFGTTNYAQKFQGRVTITADQSTSTAYMDLSNLRSEDTAVYYCARVKDGYCTLTSCPVGWYFDLWGRGTLVTVSSGTGGSGGTGSGTGGSTEIVMTQSPGTLSLSPGERATLSCRASQSVSSSYLAWYQQKPGQAPRLLIFGASSRATGIPDRFSGSGSGTDFTLTISRLEPEDFAVYYCQQYGSSLTFGGGTKLEIKR

SEQ ID NO: 224 - DNA, 738 bp, Artificial
  SC06-329
  CDS (1)..(738)
gaggtccagctggtacagtctggggctgaggttaagaagcctgggtcctcggtgaaggtctcctgcaaggcttctggaggcatcttcagaagcaattctatcagttgggtgcgacaggcccctgggcaagggcttgagtggatgggagggatcttcgctcttttcggaacaacagactacgcgcagaagttccagggcagagtcacgattaccgcggacgaatcttcgaccacagtctacctggagctgagtagcctgacatctgaggacacggccgtttattactgtgcgagaggcagtggctacaccacacgcaactactttgactactggggccagggcaccctggtcaccgtctcgagcggtacgggcggttcaggcggaaccggcagcggcactggcgggtcgacggaaattgtgctgactcagtctccaggcaccctgtctttgtctccaggggaaagagccacactctcctgcagggccagtcagagtgttagcagcaactacttaggctggtaccagcagaaacctggccaggctcccaggctcctgatctatggtgcatccagcagggccagtggcatcccagacaggttcagtggcggtgggtctgggacagacttcactctcaccatcagcagactggagcctgaagattttgcagtgtattactgtcagcagtatggtagctcacccctcactttcggcggagggaccaaggtggagatcaaacgt

SEQ ID NO: 225 - protein, 246 aa, Artificial
  Synthetic Construct
EVQLVQSGAEVKKPGSSVKVSCKASGGIFRSNSISWVRQAPGQGLEWMGGIFALFGTTDYAQKFQGRVTITADESSTTVYLELSSLTSEDTAVYYCARGSGYTTRNYFDYWGQGTLVTVSSGTGGSGGTGSGTGGSTEIVLTQSPGTLSLSPGERATLSCRASQSVSSNYLGWYQQKPGQAPRLLIYGASSRASGIPDRFSGGGSGTDFTLTISRLEPEDFAVYYCQQYGSSPLTFGGGTKVEIKR

SEQ ID NO: 226 - DNA, 729 bp, Artificial
  SC06-332
  CDS (1)..(729)
caggtgcagctggtgcagtctggggctgaggtgaagaagcctgggtcctcggtaaaggtctcctgcaaggcttctggaggccccttccgcaattttgctatcaactgggtgcgacaggcccctggacaagggcttgagtggatgggagggatcatcgctgtctttgggacgacaaagtacgcacataagttccagggcagagtcaccatcaccgcggacgactccacaaatacagcttacatggagctgggcagcctgaaatctgaggacacggccgtgtattactgtgcgagaggtccccactactactcctcctacatggacgtctggggcgaagggaccacggtcaccgtctcgagcggtacgggcggttcaggcggaaccggcagcggcactggcgggtcgacggacatccagttgacccagtctccatcctccctgtctgcatctgtaggagacagagtcaccatcacttgccgggcgagtcagggcattagcacttatttagcctggtatcagcagaaacccgggaaagttcctaaactcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgccccttctttcggccctgggaccaaagtggatatcaaacgt

SEQ ID NO: 227 - protein, 243 aa, Artificial
  Synthetic Construct
QVQLVQSGAEVKKPGSSVKVSCKASGGPFRNFAINWVRQAPGQGLEWMGGIIAVFGTTKYAHKFQGRVTITADDSTNTAYMELGSLKSEDTAVYYCARGPHYYSSYMDVWGEGTTVTVSSGTGGSGGTGSGTGGSTDIQLTQSPSSLSASVGDRVTITCRASQGISTYLAWYQQKPGKVPKLLIYAASTLQSGVPSRFSGSGSGTDFTLTISSLQPEDVATYYCQKYNSAPSFGPGTKVDIKR

SEQ ID NO: 228 - DNA, 735 bp, Artificial
  SC06-334
  CDS (1)..(735)
gaggtgcagctggtggagactggggctgaggtgaagaagcctgggtcctcggtgaaggtcccctgcaaatcttctggaagccccttcaggagtaatgctgtcagctgggtgcgacaggcccccggacaagggcttgagtgggtgggaggaatcctcggtgtctttggttcaccaagctacgcacagaagttccagggcagagtcacgattaccgcggacgaatccaccaacacagtccacatggagctgagaggtttgagatctgaggacacggccgtgtattattgtgcgagaggtcctacctactactactcctacatggacgtctggggcaaagggaccacggtcaccgtctcgagcggtacgggcggttcaggcggaaccggcagcggcactggcgggtcgacgtcctatgtgctgactcagccaccctcggagtcagtggccccaggacagacggccaggattacctgtgggggaaataacattggaagaaatagtgtgcactggtatcagcagaagccaggccaggcccctgtgctggtcgtgtatgatgatagcgaccggccctcagggatccctgagcgattttctggctccaagtctgggaacacggccaccctgattatcagcagggtcgaagtcggggatgaggccgactactactgtcaggtgtggcatagtagtagtgatcattatgtcttcggaactgggaccaaggtcaccgtcctaggt

SEQ ID NO: 229 - protein, 245 aa, Artificial
  Synthetic Construct
EVQLVETGAEVKKPGSSVKVPCKSSGSPFRSNAVSWVRQAPGQGLEWVGGILGVFGSPSYAQKFQGRVTITADESTNTVHMELRGLRSEDTAVYYCARGPTYYYSYMDVWGKGTTVTVSSGTGGSGGTGSGTGGSTSYVLTQPPSESVAPGQTARITCGGNNIGRNSVHWYQQKPGQAPVLVVYDDSDRPSGIPERFSGSKSGNTATLIISRVEVGDEADYYCQVWHSSSDHYVFGTGTKVTVLG

SEQ ID NO: 230 - DNA, 735 bp, Artificial
  SC06-336
  CDS (1)..(735)
cagatgcagctggtacaatctggagctgaggtgaagaagcctgggtcctcggtgaaggtctcctgcaaggcttctggaggcaccttcagcagctatgctatcagctgggtgcgacaggcccctggacaagggcttgagtggatgggagggatcttcggtatgtttgggacagcaaactacgcgcagaagttccagggcagagtcacgattaccgcggacgaattcacgagcgcggcctacatggagctgagcagcctgggatctgaggacacggccatgtattactgtgcgaggtctagtggttattacccccaatacttccaggactggggccagggcaccctggtcaccgtctcgagcggtacgggcggttcaggcggaaccggcagcggcactggcgggtcgacggaaattgtgatgacacagtctccaggcaccctgtctttgtctccagggcaaagagccaccctctcctgcagggccagtcagagtgttagcagcagctacttagcctggtaccagcagaaacctggccaggctcccagactcctcatgtatggtgcatccagcagggccactggcatcccagacaggttcagtggcagtgggtctgggacagacttcactctcaccatcagcagactggagcctgaagattttgcagtgtattactgtcagcagtatggtagctcatcgctcactttcggcggagggaccaagctggagatcaaacgt

SEQ ID NO: 231 - protein, 245 aa, Artificial
  Synthetic Construct
QMQLVQSGAEVKKPGSSVKVSCKASGGTFSSYAISWVRQAPGQGLEWMGGIFGMFGTANYAQKFQGRVTITADEFTSAAYMELSSLGSEDTAMYYCARSSGYYPQYFQDWGQGTLVTVSSGTGGSGGTGSGTGGSTEIVMTQSPGTLSLSPGQRATLSCRASQSVSSSYLAWYQQKPGQAPRLLMYGASSRATGIPDRFSGSGSGTDFTLTISRLEPEDFAVYYCQQYGSSSLTFGGGTKLEIKR

SEQ ID NO: 232 - DNA, 738 bp, Artificial
  SC06-339
  CDS (1)..(738)
gaggtgcagctggtggagtccggggctgaggtgaagaagcctgggtcctcggtgaaggtctcctgcaaggcttctggaggcatcttcaacagttatgctatcagctgggtgcgacaggcccctggacaagggcttgagtggatgggaggcatcatcgctatctttcatacaccaaagtacgcacagaagttccagggcagagtcacgattaccgcggacgaatccacgaacacagcctacatggaactgagaagcctgaaatctgaggacacggccctgtattactgtgcgagagggtccacttacgatttttcgagtggccttgactactggggccagggaaccctggtcaccgtctcgagcggtacgggcggttcaggcggaaccggcagcggcactggcgggtcgacgcaggcagggctgactcagccaccctcggtgtcagtggccccaggacagacggccaggattacctgtgggggaaacaacattggaagtaaaagtgtgcactggtaccagcagaagccaggccaggcccctgtcctagtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatgtggtattcggcggagggaccaagctgaccgtcctaggt

SEQ ID NO: 233 - protein, 246 aa, Artificial
  Synthetic Construct
EVQLVESGAEVKKPGSSVKVSCKASGGIFNSYAISWVRQAPGQGLEWMGGIIAIFHTPKYAQKFQGRVTITADESTNTAYMELRSLKSEDTALYYCARGSTYDFSSGLDYWGQGTLVTVSSGTGGSGGTGSGTGGSTQAGLTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLG

SEQ ID NO: 234 - DNA, 768 bp, Artificial
  SC06-342
  CDS (1)..(768)
caggtccagctggtgcagtctggggctgaggtgaagaagcctgggtcctcggtgaaggtctcctgcaaggcttctggaggcttcttcagcagctatgctatcagctgggtgcgccaggcccctggacaaggacttgagtggatggggggggtcatccctatctttcgtacagcaaactacgcacagaacttccagggcagagtcaccattaccgcggacgaattcacatcgtatatggagctgagcagcctgagatctgacgacacggccgtgtattactgtgcgaggttgaattaccatgattcggggacttattataacgccccccggggctggttcgacccctggggccagggaaccctggtcaccgtctcgagcggtacgggcggttcaggcggaaccggcagcggcactggcgggtcgacggacatccagatgacccagtctccagactccctggctgtgtctctgggcgagaaggccaccatcaactgcaagtccagccagagtattttaaacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtagtccgccgacgttcggccaagggaccaaggtggaaatcaaacgt

SEQ ID NO: 235 - protein, 256 aa, Artificial
  Synthetic Construct
QVQLVQSGAEVKKPGSSVKVSCKASGGFFSSYAISWVRQAPGQGLEWMGGVIPIFRTANYAQNFQGRVTITADEFTSYMELSSLRSDDTAVYYCARLNYHDSGTYYNAPRGWFDPWGQGTLVTVSSGTGGSGGTGSGTGGSTDIQMTQSPDSLAVSLGEKATINCKSSQSILNSSNNKNYLAWYQQKPGQPPKLLIYWASTRESGVPDRFSGSGSGTDFTLTISSLQAEDVAVYYCQQYYSSPPTFGQGTKVEIKR

SEQ ID NO: 236 - DNA, 735 bp, Artificial
  SC06-343
  CDS (1)..(735)
caggtccagctggtgcagtctggagctgaggtgaagaagcctgggtcctcggtgaaggtctcctgcaaggcttctggagtcaccttcagttactatgctatgagctgggtgcgacaggcccctggacaagggcttgagtggatgggaggaatcagccctatgtttgggacaacaacctacgcacagaagttccagggcagagtcacgattactgcggacgactccacgagtacagcctacatggaggtgaggagcctgagatctgaggacacggccgtgtattactgtgcgagatcttcgaattactatgatagtgtatatgactactggggccagggaaccctggtcaccgtctcgagcggtacgggcggttcaggcggaaccggcagcggcactggcgggtcgacgcagtctgtcgtgacgcagccgccctcggagtcagtggccccaggacagacggccaggattacctgtgggggacataacattggaagtaatagtgtgcactggtaccagcagaagccaggccaggcccctgtgctggtcgtgtatgataatagcgaccggccctcagggatccctgagcgattctctggctccaactctgggaacacggccaccctgaccatcagcagggtcgaagccggggatgaggccgactattactgtcaggtgtggggtagtagtagtgaccattatgtcttcggaactgggaccaaggtcaccgtcctaggt

SEQ ID NO: 237 - protein, 245 aa, Artificial
  Synthetic Construct
QVQLVQSGAEVKKPGSSVKVSCKASGVTFSYYAMSWVRQAPGQGLEWMGGISPMFGTTTYAQKFQGRVTITADDSTSTAYMEVRSLRSEDTAVYYCARSSNYYDSVYDYWGQGTLVTVSSGTGGSGGTGSGTGGSTQSVVTQPPSESVAPGQTARITCGGHNIGSNSVHWYQQKPGQAPVLVVYDNSDRPSGIPERFSGSNSGNTATLTISRVEAGDEADYYCQVWGSSSDHYVFGTGTKVTVLG

SEQ ID NO: 238 - protein, 5 aa, Homo sapiens
GYYVY

SEQ ID NO: 239 - protein, 17 aa, Homo sapiens
WISAYNGNTNYAQKFQG

SEQ ID NO: 240 - protein, 6 aa, Homo sapiens
SRSLDV

SEQ ID NO: 241 - protein, 17 aa, Homo sapiens
KSSQSVLYSSNNKNYLA

SEQ ID NO: 242 - protein, 7 aa, Homo sapiens
WASTRES

SEQ ID NO: 243 - protein, 9 aa, Homo sapiens
QQYYSTPLT

SEQ ID NO: 244 - protein, 5 aa, Homo sapiens
SYAIT

SEQ ID NO: 245 - protein, 17 aa, Homo sapiens
GIIGMFGSTNYAQNFQG

SEQ ID NO: 246 - protein, 11 aa, Homo sapiens
STGYYPAYLHH

SEQ ID NO: 247 - protein, 14 aa, Homo sapiens
TGTSSDVGGYNYVS

SEQ ID NO: 248 - protein, 7 aa, Homo sapiens
DVSKRPS

SEQ ID NO: 249 - protein, 10 aa, Homo sapiens
SSYTSSSTHV

SEQ ID NO: 250 - protein, 5 aa, Homo sapiens
SYYMH

SEQ ID NO: 251 - protein, 17 aa, Homo sapiens
WINPNSGGTNYAQKFQG

SEQ ID NO: 252 - protein, 12 aa, Homo sapiens
EGKWGPQAAFDI

SEQ ID NO: 253 - protein, 12 aa, Homo sapiens
RASQSVSSSYLA

SEQ ID NO: 254 - protein, 7 aa, Homo sapiens
DASSRAT

SEQ ID NO: 255 - protein, 8 aa, Homo sapiens
QQYGSSLW

SEQ ID NO: 256 - protein, 5 aa, Homo sapiens
IYAMS

SEQ ID NO: 257 - protein, 17 aa, Homo sapiens
AISSSGDSTYYADSVKG

SEQ ID NO: 258 - protein, 8 aa, Homo sapiens
AYGYTFDP

SEQ ID NO: 259 - protein, 16 aa, Homo sapiens
RSSQSLLHSNGYNYLD

SEQ ID NO: 260 - protein, 7 aa, Homo sapiens
LGSNRAS

SEQ ID NO: 261 - protein, 8 aa, Homo sapiens
MQALQTPL

SEQ ID NO: 262 - protein, 5 aa, Homo sapiens
THAIS

SEQ ID NO: 263 - protein, 17 aa, Homo sapiens
GIIAIFGTANYAQKFQG

SEQ ID NO: 264 - protein, 12 aa, Homo sapiens
GSGYHISTPFDN

SEQ ID NO: 265 - protein, 11 aa, Homo sapiens
GGNNIGSKGVH

SEQ ID NO: 266 - protein, 7 aa, Homo sapiens
DDSDRPS

SEQ ID NO: 267 - protein, 11 aa, Homo sapiens
QVWDSSSDHVV

SEQ ID NO: 268 - protein, 5 aa, Homo sapiens
GYAIS

SEQ ID NO: 269 - protein, 17 aa, Homo sapiens
GIIPIFGTTNYAQKFQG

SEQ ID NO: 270 - protein, 19 aa, Homo sapiens
VKDGYCTLTSCPVGWYFDL

SEQ ID NO: 271 - protein, 12 aa, Homo sapiens
RASQSVSSSYLA

SEQ ID NO: 272 - protein, 7 aa, Homo sapiens
GASSRAT

SEQ ID NO: 273 - protein, 8 aa, Homo sapiens
QQYGSSLT

SEQ ID NO: 274 - protein, 5 aa, Homo sapiens
SNSIS

SEQ ID NO: 275 - protein, 17 aa, Homo sapiens
GIFALFGTTDYAQKFQG

SEQ ID NO: 276 - protein, 12 aa, Homo sapiens
GSGYTTRNYFDY

SEQ ID NO: 277 - protein, 12 aa, Homo sapiens
RASQSVSSNYLG

SEQ ID NO: 278 - protein, 7 aa, Homo sapiens
GASSRAS

SEQ ID NO: 279 - protein, 9 aa, Homo sapiens
QQYGSSPLT

SEQ ID NO: 280 - protein, 5 aa, Homo sapiens
NFAIN

SEQ ID NO: 281 - protein, 17 aa, Homo sapiens
GIIAVFGTTKYAHKFQG

SEQ ID NO: 282 - protein, 11 aa, Homo sapiens
GPHYYSSYMDV

SEQ ID NO: 283 - protein, 11 aa, Homo sapiens
RASQGISTYLA

SEQ ID NO: 284 - protein, 7 aa, Homo sapiens
AASTLQS

SEQ ID NO: 285 - protein, 8 aa, Homo sapiens
QKYNSAPS

SEQ ID NO: 286 - protein, 5 aa, Homo sapiens
SNAVS

SEQ ID NO: 287 - protein, 17 aa, Homo sapiens
GILGVFGSPSYAQKFQG

SEQ ID NO: 288 - protein, 11 aa, Homo sapiens
GPTYYYSYMDV

SEQ ID NO: 289 - protein, 11 aa, Homo sapiens
GGNNIGRNSVH

SEQ ID NO: 290 - protein, 7 aa, Homo sapiens
DDSDRPS

SEQ ID NO: 291 - protein, 11 aa, Homo sapiens
QVWHSSSDHYV

SEQ ID NO: 292 - protein, 5 aa, Homo sapiens
SYAIS

SEQ ID NO: 293 - protein, 17 aa, Homo sapiens
GIFGMFGTANYAQKFQG

SEQ ID NO: 294 - protein, 11 aa, Homo sapiens
SSGYYPQYFQD

SEQ ID NO: 295 - protein, 12 aa, Homo sapiens
RASQSVSSSYLA

SEQ ID NO: 296 - protein, 7 aa, Homo sapiens
GASSRAT

SEQ ID NO: 297 - protein, 9 aa, Homo sapiens
QQYGSSSLT

SEQ ID NO: 298 - protein, 5 aa, Homo sapiens
SYAIS

SEQ ID NO: 299 - protein, 17 aa, Homo sapiens
GIIAIFHTPKYAQKFQG

SEQ ID NO: 300 - protein, 12 aa, Homo sapiens
GSTYDFSSGLDY

SEQ ID NO: 301 - protein, 11 aa, Homo sapiens
GGNNIGSKSVH

SEQ ID NO: 302 - protein, 7 aa, Homo sapiens
DDSDRPS

SEQ ID NO: 303 - protein, 11 aa, Homo sapiens
QVWDSSSDHVV

SEQ ID NO: 304 - protein, 5 aa, Homo sapiens
SYAIS

SEQ ID NO: 305 - protein, 17 aa, Homo sapiens
GVIPIFRTANYAQNFQG

SEQ ID NO: 306 - protein, 19 aa, Homo sapiens
LNYHDSGTYYNAPRGWFDP

SEQ ID NO: 307 - protein, 17 aa, Homo sapiens
KSSQSILNSSNNKNYLA

SEQ ID NO: 308 - protein, 7 aa, Homo sapiens
WASTRES

SEQ ID NO: 309 - protein, 9 aa, Homo sapiens
QQYYSSPPT

SEQ ID NO: 310 - protein, 5 aa, Homo sapiens
YYAMS

SEQ ID NO: 311 - protein, 17 aa, Homo sapiens
GISPMFGTTTYAQKFQG

SEQ ID NO: 312 - protein, 11 aa, Homo sapiens
SSNYYDSVYDY

SEQ ID NO: 313 - protein, 11 aa, Homo sapiens
GGHNIGSNSVH

SEQ ID NO: 314 - protein, 7 aa, Homo sapiens
DNSDRPS

SEQ ID NO: 315 - protein, 11 aa, Homo sapiens
QVWGSSSDHYV

SEQ ID NO: 316 - DNA, 1335 bp, Artificial
  CR6141 Heavy chain
  CDS (1)..(1335)
gaggtccagctggtgcagtctggggctgaggtgaagaagcctggggcctcagtgaaggtctcctgcaaggcttctgggtacaccttcaccggctactatgtgtactgggtgcgacaggcccctggacaagggcttgagtggatgggatggatcagcgcttacaatggtaacacaaactatgcacagaagttccagggcagagtcacgattaccgcggacaaatccacgagcacagcctacatggagctgagcagcctgagatctgaagacacggctgtgtattactgtgcgagaagtagatccctggacgtctggggccaagggaccacggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 317 - protein, 445 aa, Artificial
  Synthetic Construct
EVQLVQSGAEVKKPGASVKVSCKASGYTFTGYYVYWVRQAPGQGLEWMGWISAYNGNTNYAQKFQGRVTITADKSTSTAYMELSSLRSEDTAVYYCARSRSLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 318 - DNA, 657 bp, Artificial
  CR6141 Light chain
  CDS (1)..(657)
gatgttgtgatgactcagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctctcactttcggcggagggaccaaagtggatatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 319 - protein, 219 aa, Artificial
  Synthetic Construct
DVVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVDIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 320 - DNA, 1350 bp, Artificial
  CR6272 Heavy chain
  CDS (1)..(1350)
cagatgcagctggtgcagtctggggctgaggtgaagaagcctgggtcctcggtgaaggtctcctgcaaggcttctggaggcaccttctccagttatgctatcacctgggtgcgacaggcccctggacaagggcttgagtggatgggagggatcatcggtatgtttggttcaacaaactacgcacagaacttccagggcagagtcacgattaccgcggacgaatccacgagcacagcctacatggagctgagcagcctcagatctgaggacacggccgtgtattactgtgcgagaagtactggttattaccctgcatacctccaccactggggccagggcaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 321 - protein, 450 aa, Artificial
  Synthetic Construct
QMQLVQSGAEVKKPGSSVKVSCKASGGTFSSYAITWVRQAPGQGLEWMGGIIGMFGSTNYAQNFQGRVTITADESTSTAYMELSSLRSEDTAVYYCARSTGYYPAYLHHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 322 - DNA, 660 bp, Artificial
  CR6272 Light chain
  CDS (1)..(660)
cagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgcagctcatatacaagcagcagcactcatgtcttcggaactgggaccaaggtcaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 323 - protein, 220 aa, Artificial
  Synthetic Construct
QSALTQPRSVSGSPGQSVTISCTGTSSDVGGYNYVSWYQQHPGKAPKLMIYDVSKRPSGVPDRFSGSKSGNTASLTISGLQAEDEADYYCSSYTSSSTHVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 324 - DNA, 1353 bp, Artificial
  CR6296 Heavy chain
  CDS (1)..(1353)
gaggtgcagctggtggagaccggggctgaggtgaagaagcctggggcctcagtgaaggtttcctgcaaggcatctggatacaccttcaccagctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagaggggaaatggggacctcaagcggcttttgatatctggggccaagggacaatggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 325 - protein, 451 aa, Artificial
  Synthetic Construct
EVQLVETGAEVKKPGASVKVSCKASGYTFTSYYMHWVRQAPGQGLEWMGWINPNSGGTNYAQKFQGRVTMTRDTSISTAYMELSRLRSDDTAVYYCAREGKWGPQAAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 326 - DNA, 642 bp, Artificial
  CR6296 Light chain
  CDS (1)..(642)
gaaattgtgatgacgcagtctccaggcaccctgtctttgtctccaggggaaagagccaccctctcctgcagggccagtcagagtgttagcagcagctacttagcctggtaccagcagaaacctggccaggctcccaggctcctcatctatgatgcatccagcagggccactgacatcccagacaggttcagtggcagtgggtctgggacagacttcactctcaccatcagcagactggagcctgaagattttgcagtgtattactgtcagcagtatggtagctcactttggacgttcggccaagggaccaaggtggagatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 327 - protein, 214 aa, Artificial
  Synthetic Construct
EIVMTQSPGTLSLSPGERATLSCRASQSVSSSYLAWYQQKPGQAPRLLIYDASSRATDIPDRFSGSGSGTDFTLTISRLEPEDFAVYYCQQYGSSLWTFGQGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 328 - DNA, 1341 bp, Artificial
  CR6301 Heavy chain
  CDS (1)..(1341)
gaggtgcagctggtagagtctgggggaggcttggtacagcctggggggtccctgagactctcctgtgcagcctctggattcacctttagcatctatgccatgagctgggtccgccaggcaccagggaaggggctggagtgggtctcagctattagtagtagtggtgatagcacatactacgcagactccgtgaagggccggttcaccatctccagagacaacgccaggaacacgctgtatctgcaaatgaacagtctgagagccgaggacacggctgtgtattactgtgcgagagcgtatggctacacgttcgacccctggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 329 - protein, 447 aa, Artificial
  Synthetic Construct
EVQLVESGGGLVQPGGSLRLSCAASGFTFSIYAMSWVRQAPGKGLEWVSAISSSGDSTYYADSVKGRFTISRDNARNTLYLQMNSLRAEDTAVYYCARAYGYTFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 330 - DNA, 654 bp, Artificial
  CR6301 Light chain
  CDS (1)..(654)
gaaattgtgctgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcccctcactttcggcggagggaccaaggtggagatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 331 - protein, 218 aa, Artificial
  Synthetic Construct
EIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 332 - DNA, 1353 bp, Artificial
  CR6327 Heavy chain
  CDS (1)..(1353)
gaggtgcagctggtggagaccggggctgaggtgaagaagcctgggtcctcggtgaaggtctcctgcaaggcctctggaggcaccttcaggacccatgctatcagttgggtgcgacaggcccctggacaagggcttgagtggatgggagggatcatcgctatcttcggaacagcaaactacgcacagaagttccagggcagaatcacgattaccgcggacgaatccacgagtacagcctacatggagctgagcagcctgagatctgaggacacggccgtgtatttctgtgcgagaggcagtggttatcatatatcgacaccctttgacaactggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 333 - protein, 451 aa, Artificial
  Synthetic Construct
EVQLVETGAEVKKPGSSVKVSCKASGGTFRTHAISWVRQAPGQGLEWMGGIIAIFGTANYAQKFQGRITITADESTSTAYMELSSLRSEDTAVYFCARGSGYHISTPFDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 334 - DNA, 654 bp, Artificial
  CR6327 Light chain
  CDS (1)..(654)
tcctatgtgctgactcagccaccctcggtgtcagtggccccaggacagacggccaggattacctgtgggggaaacaacattggaagtaaaggtgtgcactggtaccagcagaagcctggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatgtggtattcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 335 - protein, 218 aa, Artificial
  Synthetic Construct
SYVLTQPPSVSVAPGQTARITCGGNNIGSKGVHWYQQKPGQAPVLVVYDDSDRPSGIPERFSGSNSGNTATLTISRVEAGDEADYYCQVWDSSSDHVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 336 - DNA, 1374 bp, Artificial
  CR6328 Heavy chain
  CDS (1)..(1374)
gaggtgcagctggtggagtctggggctgaggtgaagaagcctgggtcctcggtgaaggtctcctgcaaggcttctggacacatcttcagcggctatgcaatcagttgggtgcgacaggcccctggacaagggcttgagtggatgggagggatcatccctatctttggtacaacaaactacgcacagaagttccagggcagagtcacgattaccgcggaccaatccacgagcacagcctacatggacctgagcaacttgagatctgaggacacggccgtctattactgtgcgagagtgaaagatggatattgtactcttaccagctgccctgtcggctggtacttcgatctctggggccgtggcaccctggtcactgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 337 - protein, 458 aa, Artificial
  Synthetic Construct
EVQLVESGAEVKKPGSSVKVSCKASGHIFSGYAISWVRQAPGQGLEWMGGIIPIFGTTNYAQKFQGRVTITADQSTSTAYMDLSNLRSEDTAVYYCARVKDGYCTLTSCPVGWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 338 - DNA, 639 bp, Artificial
  CR6328 Light chain
  CDS (1)..(639)
gaaattgtgatgacgcagtctccaggcaccctgtctttgtctccaggggaaagagccaccctctcgtgcagggccagtcagagtgttagcagcagctacttagcctggtaccagcagaaacctggccaggctcccaggctcctcatctttggtgcctccagcagggccactggcatcccagacaggttcagtggcagtgggtctgggacagacttcactctcaccatcagcagactggagcctgaagattttgcagtgtattactgtcagcagtatggtagctcactcactttcggcggagggaccaagctggagatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 339 - protein, 213 aa, Artificial
  Synthetic Construct
EIVMTQSPGTLSLSPGERATLSCRASQSVSSSYLAWYQQKPGQAPRLLIFGASSRATGIPDRFSGSGSGTDFTLTISRLEPEDFAVYYCQQYGSSLTFGGGTKLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 340 - DNA, 1353 bp, Artificial
  CR6329 Heavy chain
  CDS (1)..(1353)
gaggtccagctggtacagtctggggctgaggttaagaagcctgggtcctcggtgaaggtctcctgcaaggcttctggaggcatcttcagaagcaattctatcagttgggtgcgacaggcccctgggcaagggcttgagtggatgggagggatcttcgctcttttcggaacaacagactacgcgcagaagttccagggcagagtcacgattaccgcggacgaatcttcgaccacagtctacctggagctgagtagcctgacatctgaggacacggccgtttattactgtgcgagaggcagtggctacaccacacgcaactactttgactactggggccagggcaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 341 - protein, 451 aa, Artificial
  Synthetic Construct
EVQLVQSGAEVKKPGSSVKVSCKASGGIFRSNSISWVRQAPGQGLEWMGGIFALFGTTDYAQKFQGRVTITADESSTTVYLELSSLTSEDTAVYYCARGSGYTTRNYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 342 - DNA, 654 bp, Artificial
  CR6329 Light chain
  CDS (1)..(654)
gaaattgtgctgactcagtctccaggcaccctgtctttgtctccaggggaaagagccacactctcctgcagggccagtcagagtgttagcagcaactacttaggctggtaccagcagaaacctggccaggctcccaggctcctgatctatggtgcatccagcagggccagtggcatcccagacaggttcagtggcggtgggtctgggacagacttcactctcaccatcagcagactggagcctgaagattttgcagtgtattactgtcagcagtatggtagctcacccctcactttcggcggagggaccaaggtggagatcaaacgtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 343 - protein, 218 aa, Artificial
  Synthetic Construct
EIVLTQSPGTLSLSPGERATLSCRASQSVSSNYLGWYQQKPGQAPRLLIYGASSRASGIPDRFSGGGSGTDFTLTISRLEPEDFAVYYCQQYGSSPLTFGGGTKVEIKRAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 344 - DNA, 1350 bp, Artificial
  CR6332 Heavy chain
  CDS (1)..(1350)
caggtgcagctggtgcagtctggggctgaggtgaagaagcctgggtcctcggtaaaggtctcctgcaaggcttctggaggccccttccgcaattttgctatcaactgggtgcgacaggcccctggacaagggcttgagtggatgggagggatcatcgctgtctttgggacgacaaagtacgcacataagttccagggcagagtcaccatcaccgcggacgactccacaaatacagcttacatggagctgggcagcctgaaatctgaggacacggccgtgtattactgtgcgagaggtccccactactactcctcctacatggacgtctggggcgaagggaccacggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 345 - protein, 450 aa, Artificial
  Synthetic Construct
QVQLVQSGAEVKKPGSSVKVSCKASGGPFRNFAINWVRQAPGQGLEWMGGIIAVFGTTKYAHKFQGRVTITADDSTNTAYMELGSLKSEDTAVYYCARGPHYYSSYMDVWGEGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 346 - DNA, 636 bp, Artificial
  CR6332 Light chain
  CDS (1)..(636)
gacatccagttgacccagtctccatcctccctgtctgcatctgtaggagacagagtcaccatcacttgccgggcgagtcagggcattagcacttatttagcctggtatcagcagaaacccgggaaagttcctaaactcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgccccttctttcggccctgggaccaaagtggatatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 347 - protein, 212 aa, Artificial
  Synthetic Construct
DIQLTQSPSSLSASVGDRVTITCRASQGISTYLAWYQQKPGKVPKLLIYAASTLQSGVPSRFSGSGSGTDFTLTISSLQPEDVATYYCQKYNSAPSFGPGTKVDIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 348 - DNA, 1350 bp, Artificial
  CR6334 Heavy chain
  CDS (1)..(1350)
gaggtgcagctggtggagactggggctgaggtgaagaagcctgggtcctcggtgaaggtcccctgcaaatcttctggaagccccttcaggagtaatgctgtcagctgggtgcgacaggcccccggacaagggcttgagtgggtgggaggaatcctcggtgtctttggttcaccaagctacgcacagaagttccagggcagagtcacgattaccgcggacgaatccaccaacacagtccacatggagctgagaggtttgagatctgaggacacggccgtgtattattgtgcgagaggtcctacctactactactcctacatggacgtctggggcaaagggaccacggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 349 - protein, 450 aa, Artificial [sequence omitted]

SEQ ID NO: 350 - DNA, 654 bp, Artificial
  CR6334 Light chain
  CDS (1)..(654)
tcctatgtgctgactcagccaccctcggagtcagtggccccaggacagacggccaggattacctgtgggggaaataacattggaagaaatagtgtgcactggtatcagcagaagccaggccaggcccctgtgctggtcgtgtatgatgatagcgaccggccctcagggatccctgagcgattttctggctccaagtctgggaacacggccaccctgattatcagcagggtcgaagtcggggatgaggccgactactactgtcaggtgtggcatagtagtagtgatcattatgtcttcggaactgggaccaaggtcaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 351 - protein, 218 aa, Artificial
  Synthetic Construct
SYVLTQPPSESVAPGQTARITCGGNNIGRNSVHWYQQKPGQAPVLVVYDDSDRPSGIPERFSGSKSGNTATLIISRVEVGDEADYYCQVWHSSSDHYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 352 - DNA, 1350 bp, Artificial
  CR6336 Heavy chain
  CDS (1)..(1350)
cagatgcagctggtacaatctggagctgaggtgaagaagcctgggtcctcggtgaaggtctcctgcaaggcttctggaggcaccttcagcagctatgctatcagctgggtgcgacaggcccctggacaagggcttgagtggatgggagggatcttcggtatgtttgggacagcaaactacgcgcagaagttccagggcagagtcacgattaccgcggacgaattcacgagcgcggcctacatggagctgagcagcctgggatctgaggacacggccatgtattactgtgcgaggtctagtggttattacccccaatacttccaggactggggccagggcaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 353 - protein, 450 aa, Artificial
  Synthetic Construct
QMQLVQSGAEVKKPGSSVKVSCKASGGTFSSYAISWVRQAPGQGLEWMGGIFGMFGTANYAQKFQGRVTITADEFTSAAYMELSSLGSEDTAMYYCARSSGYYPQYFQDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 354 - DNA, 642 bp, Artificial
  CR6336 Light chain
  CDS (1)..(642)
gaaattgtgatgacacagtctccaggcaccctgtctttgtctccagggcaaagagccaccctctcctgcagggccagtcagagtgttagcagcagctacttagcctggtaccagcagaaacctggccaggctcccagactcctcatgtatggtgcatccagcagggccactggcatcccagacaggttcagtggcagtgggtctgggacagacttcactctcaccatcagcagactggagcctgaagattttgcagtgtattactgtcagcagtatggtagctcatcgctcactttcggcggagggaccaagctggagatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 355 - protein, 214 aa, Artificial
  Synthetic Construct
EIVMTQSPGTLSLSPGQRATLSCRASQSVSSSYLAWYQQKPGQAPRLLMYGASSRATGIPDRFSGSGSGTDFTLTISRLEPEDFAVYYCQQYGSSSLTFGGGTKLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 356 - DNA, 1353 bp, Artificial
  CR6339 Heavy chain
  CDS (1)..(1353)
gaggtgcagctggtggagtccggggctgaggtgaagaagcctgggtcctcggtgaaggtctcctgcaaggcttctggaggcatcttcaacagttatgctatcagctgggtgcgacaggcccctggacaagggcttgagtggatgggaggcatcatcgctatctttcatacaccaaagtacgcacagaagttccagggcagagtcacgattaccgcggacgaatccacgaacacagcctacatggaactgagaagcctgaaatctgaggacacggccctgtattactgtgcgagagggtccacttacgatttttcgagtggccttgactactggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 357 - protein, 451 aa, Artificial
  Synthetic Construct
EVQLVESGAEVKKPGSSVKVSCKASGGIFNSYAISWVRQAPGQGLEWMGGIIAIFHTPKYAQKFQGRVTITADESTNTAYMELRSLKSEDTALYYCARGSTYDFSSGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 358 - DNA, 654 bp, Artificial
  CR6339 Light chain
  CDS (1)..(654)
caggcagggctgactcagccaccctcggtgtcagtggccccaggacagacggccaggattacctgtgggggaaacaacattggaagtaaaagtgtgcactggtaccagcagaagccaggccaggcccctgtcctagtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatgtggtattcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 359 - protein, 218 aa, Artificial
  Synthetic Construct
QAGLTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 360 - DNA, 1368 bp, Artificial
  CR6342 Heavy chain
  CDS (1)..(1368)
caggtccagctggtgcagtctggggctgaggtgaagaagcctgggtcctcggtgaaggtctcctgcaaggcttctggaggcttcttcagcagctatgctatcagctgggtgcgccaggcccctggacaaggacttgagtggatggggggggtcatccctatctttcgtacagcaaactacgcacagaacttccagggcagagtcaccattaccgcggacgaattcacatcgtatatggagctgagcagcctgagatctgacgacacggccgtgtattactgtgcgaggttgaattaccatgattcggggacttattataacgccccccggggctggttcgacccctggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 361 - protein, 456 aa, Artificial
  Synthetic Construct
QVQLVQSGAEVKKPGSSVKVSCKASGGFFSSYAISWVRQAPGQGLEWMGGVIPIFRTANYAQNFQGRVTITADEFTSYMELSSLRSDDTAVYYCARLNYHDSGTYYNAPRGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 362 - DNA, 657 bp, Artificial
  CR6342 Light chain
  CDS (1)..(657)
gacatccagatgacccagtctccagactccctggctgtgtctctgggcgagaaggccaccatcaactgcaagtccagccagagtattttaaacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtagtccgccgacgttcggccaagggaccaaggtggaaatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 363 - protein, 219 aa, Artificial
  Synthetic Construct
DIQMTQSPDSLAVSLGEKATINCKSSQSILNSSNNKNYLAWYQQKPGQPPKLLIYWASTRESGVPDRFSGSGSGTDFTLTISSLQAEDVAVYYCQQYYSSPPTFGQGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 364 - DNA, 1350 bp, Artificial
  CR6343 Heavy chain
  CDS (1)..(1350)
caggtccagctggtgcagtctggagctgaggtgaagaagcctgggtcctcggtgaaggtctcctgcaaggcttctggagtcaccttcagttactatgctatgagctgggtgcgacaggcccctggacaagggcttgagtggatgggaggaatcagccctatgtttgggacaacaacctacgcacagaagttccagggcagagtcacgattactgcggacgactccacgagtacagcctacatggaggtgaggagcctgagatctgaggacacggccgtgtattactgtgcgagatcttcgaattactatgatagtgtatatgactactggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 365 - protein, 450 aa, Artificial
  Synthetic Construct
QVQLVQSGAEVKKPGSSVKVSCKASGVTFSYYAMSWVRQAPGQGLEWMGGISPMFGTTTYAQKFQGRVTITADDSTSTAYMEVRSLRSEDTAVYYCARSSNYYDSVYDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 366 - DNA, 654 bp, Artificial
  CR6343 Light chain
  CDS (1)..(654)
cagtctgtcgtgacgcagccgccctcggagtcagtggccccaggacagacggccaggattacctgtgggggacataacattggaagtaatagtgtgcactggtaccagcagaagccaggccaggcccctgtgctggtcgtgtatgataatagcgaccggccctcagggatccctgagcgattctctggctccaactctgggaacacggccaccctgaccatcagcagggtcgaagccggggatgaggccgactattactgtcaggtgtggggtagtagtagtgaccattatgtcttcggaactgggaccaaggtcaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 367 - protein, 218 aa, Artificial
  Synthetic Construct
QSVVTQPPSESVAPGQTARITCGGHNIGSNSVHWYQQKPGQAPVLVVYDNSDRPSGIPERFSGSNSGNTATLTISRVEAGDEADYYCQVWGSSSDHYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 368 - protein, 12 aa, Influenza A virus
GVTNKVNSIIDK

SEQ ID NO: 369 - protein, 12 aa, Influenza A virus
GVTNKVNSIINK

SEQ ID NO: 370 - protein, 12 aa, Influenza A virus
GVTNKENSIIDK

SEQ ID NO: 371 - protein, 12 aa, Influenza A virus
GVTNKVNRIIDK

SEQ ID NO: 372 - protein, 12 aa, Influenza A virus
GITNKVNSVIEK

SEQ ID NO: 373 - protein, 12 aa, Influenza A virus
GITNKENSVIEK

SEQ ID NO: 374 - protein, 12 aa, Influenza A virus
GITNKVNSIIDK

SEQ ID NO: 375 - protein, 12 aa, Influenza A virus
KITSKVNNIVDK

SEQ ID NO: 376 - protein, 12 aa, Influenza A virus
QINGKLNRVIEK

SEQ ID NO: 377 - protein, 12 aa, Influenza A virus
QINGKLNRLIEK

The invention claimed is:

1. An isolated binding molecule able to recognize and bind an epitope in an HA2 subunit of an influenza hemagglutinin protein (HA), wherein said binding molecule is human and has neutralizing activity against an influenza virus of H5 subtype, and wherein said binding molecule comprises a heavy chain comprising a CDR1 region of SEQ ID NO:1, a CDR2 region of SEQ ID NO:2, and a CDR3 region of SEQ ID NO:3, and framework regions of amino acids encoded by germline gene VH1-69.

2. The binding molecule according to claim 1, wherein said binding molecule also has neutralizing activity against an influenza virus comprising HA of the H1 subtype.

3. An isolated binding molecule able to bind an HA2 subunit of an influenza HA selected from the group consisting of:
   a) binding molecule comprising a heavy chain comprising a CDR1 region of SEQ ID NO:1, a CDR2 region of SEQ ID NO:2, a and CDR3 region of SEQ ID NO:3; and a light chain comprising a CDR1 region of SEQ ID NO:4, a CDR2 region of SEQ ID NO:5, and a CDR3 region of SEQ ID NO:6,
   b) a binding molecule comprising a heavy chain comprising a CDR1 region of SEQ ID NO:1, a CDR2 region of SEQ ID NO:2, a CDR3 region of SEQ ID NO:3; and a light chain comprising a CDR1 region of SEQ ID NO:7, a CDR2 region of SEQ ID NO:8, and a CDR3 region of SEQ ID NO:9,
   c) a binding molecule comprising a heavy chain comprising a CDR1 region of SEQ ID NO:1, a CDR2 region of SEQ ID NO:2, a CDR3 region of SEQ ID NO:3; and a light chain comprising a CDR1 region of SEQ ID NO:10, a CDR2 region of SEQ ID NO:11, and a CDR3 region of SEQ ID NO:12,
   d) a binding molecule comprising a heavy chain comprising a CDR1 region of SEQ ID NO:1, a CDR2 region of SEQ ID NO:2, a CDR3 region of SEQ ID NO:3; and a light chain comprising a CDR1 region of SEQ ID NO:13, a CDR2 region of SEQ ID NO:14, and a CDR3 region of SEQ ID NO:15,
   e) a binding molecule comprising a heavy chain comprising a CDR1 region of SEQ ID NO:1, a CDR2 region of SEQ ID NO:2, a CDR3 region of SEQ ID NO:3; and a light chain comprising a CDR1 region of SEQ ID NO:33, a CDR2 region of SEQ ID NO:34, and a CDR3 region of SEQ ID NO:35, and
   f) a binding molecule comprising a heavy chain comprising a CDR1 region of SEQ ID NO:1, a CDR2 region of SEQ ID NO:2, a CDR3 region of SEQ ID NO:3; and a light chain comprising a CDR1 region of SEQ ID NO:36, a CDR2 region of SEQ ID NO:37, and a CDR3 region of SEQ ID NO:38.

4. The binding molecule according to claim 3, wherein the binding molecule comprises a heavy chain comprising a CDR1 region of SEQ ID NO:1, a CDR2 region of SEQ ID NO:2, a CDR3 region of SEQ ID NO:3; and a light chain comprising a CDR1 region of SEQ ID NO:13, a CDR2 region of SEQ ID NO:14, and a CDR3 region of SEQ ID NO:15.

5. The binding molecule according to claim 1, wherein said binding molecule is a human monoclonal antibody.

6. A method of producing the isolated binding molecule of claim 1 comprising:
   expressing an isolated nucleic acid molecule encoding said binding molecule in a suitable host cell so as to produce the binding molecule.

7. A pharmaceutical composition comprising:
   the binding molecule according to claim 1, and
   a pharmaceutically acceptable excipient.

8. The binding molecule of claim 2, wherein the binding molecule also has neutralizing activity against an influenza virus of subtype H2, H6, and/or H9.

9. A method of diagnosing an influenza infection of the type wherein a monoclonal antibody binds an influenza virus in a sample from the subject, wherein the improvement comprises:
   utilizing the monoclonal antibody of claim 5 in the method.

10. A method of treating an influenza infection of the type wherein a monoclonal antibody that binds an influenza virus is administered to a subject, wherein the improvement comprises:
    utilizing the monoclonal antibody of claim 5 in the method.

11. An isolated binding molecule able to recognize and bind an epitope in an HA2 subunit of an influenza hemagglutinin protein, wherein the binding molecule comprises a heavy chain comprising a CDR1 region of SEQ ID NO: 1, a CDR2 region of SEQ ID NO: 2, and a CDR3 region of SEQ ID NO: 3, and a light chain comprising a CDR1 region of SEQ ID NO: 13, a CDR2 region of SEQ ID NO: 14, and a CDR3 region of SEQ ID NO: 15; wherein the heavy chain and the light chain have a framework encoded by germline gene VH1-69; and wherein the binding molecule has neutralizing activity against an influenza virus of H5 subtype.

* * * * *

UNITED STATES PATENT AND TRADEMARK OFFICE
CERTIFICATE OF CORRECTION

PATENT NO. : 8,192,927 B2
APPLICATION NO. : 12/310812
DATED : June 5, 2012
INVENTOR(S) : Edward Norbert Van Den Brink et al.

Page 1 of 1

It is certified that error appears in the above-identified patent and that said Letters Patent is hereby corrected as shown below:

On the title page:
In Item (54) and Column 1, Line 1    change "HUMAN BIND" TO --HUMAN BINDING--

In the claims:
CLAIM 3, COLUMN 191, LINE 18,    change "a and CDR3" to --and a CDR3--

Signed and Sealed this
Twenty-seventh Day of November, 2012

David J. Kappos
*Director of the United States Patent and Trademark Office*